(12) United States Patent
Mintz et al.

(10) Patent No.: US 7,745,391 B2
(45) Date of Patent: Jun. 29, 2010

(54) HUMAN THROMBOSPONDIN POLYPEPTIDE

(75) Inventors: Liat Mintz, East Brunswick, NJ (US); Hanqing Xie, Lambertville, NJ (US); Dvir Dahary, Tel-Aviv (IL); Erez Levanon, Petach-Tikva (IL); Shiri Freilich, Herzlia (IL); Nili Beck, Kfar Saba (IL); Wei-Yong Zhu, Plainsboro, NJ (US); Alon Wasserman, Rehovot (IL); Jeanne Bernstein, Kfar Yona (IL)

(73) Assignee: Compugen Ltd., Tel-Aviv (IL)

( * ) Notice: Subject to any disclaimer, the term of this patent is extended or adjusted under 35 U.S.C. 154(b) by 441 days.

(21) Appl. No.: 11/443,428

(22) Filed: May 31, 2006
(Under 37 CFR 1.47)

(65) Prior Publication Data

US 2007/0083334 A1 Apr. 12, 2007

Related U.S. Application Data

(63) Continuation of application No. 10/242,799, filed on Sep. 13, 2002, now abandoned.

(60) Provisional application No. 60/397,784, filed on Jul. 24, 2002, provisional application No. 60/384,096, filed on May 31, 2002, provisional application No. 60/371,494, filed on Apr. 11, 2002, provisional application No. 60/354,242, filed on Feb. 6, 2002, provisional application No. 60/324,524, filed on Sep. 26, 2001, provisional application No. 60/322,506, filed on Sep. 14, 2001, provisional application No. 60/322,359, filed on Sep. 14, 2001, provisional application No. 60/322,285, filed on Sep. 14, 2001.

(51) Int. Cl.
*A61K 38/00* (2006.01)
*C07K 14/00* (2006.01)

(52) U.S. Cl. .............................. 514/2; 514/12; 530/350
(58) Field of Classification Search .................. None
See application file for complete search history.

(56) References Cited

U.S. PATENT DOCUMENTS

| | | | |
|---|---|---|---|
| 4,215,051 A | 7/1980 | Schroeder et al. |
| 4,683,202 A | 7/1987 | Mullis |
| 4,704,692 A | 11/1987 | Ladner |
| 4,816,567 A | 3/1989 | Cabilly et al. |
| 4,868,103 A | 9/1989 | Stavrianopoulos et al. |
| 4,873,316 A | 10/1989 | Meade et al. |
| 4,946,778 A | 8/1990 | Ladner et al. |
| 4,987,071 A | 1/1991 | Cech et al. |
| 5,093,246 A | 3/1992 | Cech et al. |
| 5,116,742 A | 5/1992 | Cech et al. |
| 5,143,854 A | 9/1992 | Pirrung |
| 5,208,020 A | 5/1993 | Chari et al. |
| 5,223,409 A | 6/1993 | Ladner et al. |
| 5,225,539 A | 7/1993 | Winter |
| 5,272,057 A | 12/1993 | Smulson et al. |
| 5,283,317 A | 2/1994 | Saifer et al. |
| 5,288,514 A | 2/1994 | Ellman |
| 5,328,470 A | 7/1994 | Nabel et al. |
| 5,384,261 A | 1/1995 | Winkler et al. |
| 5,459,039 A | 10/1995 | Modrich et al. |
| 5,475,092 A | 12/1995 | Chari et al. |
| 5,498,531 A | 3/1996 | Jarrell |
| 5,510,270 A | 4/1996 | Fodor et al. |
| 5,527,681 A | 6/1996 | Holmes |
| 5,571,509 A | 11/1996 | Comoglio et al. |
| 5,585,089 A | 12/1996 | Queen et al. |
| 5,585,499 A | 12/1996 | Chari et al. |
| 5,631,169 A | 5/1997 | Lakowicz et al. |
| 5,693,761 A | 12/1997 | Queen et al. |
| 5,693,762 A | 12/1997 | Queen et al. |
| 5,695,937 A | 12/1997 | Kinzler et al. |
| 5,846,545 A | 12/1998 | Chari et al. |
| 5,854,033 A | 12/1998 | Lizardi |
| 5,876,742 A | 3/1999 | Cochrum et al. |
| 6,033,862 A | 3/2000 | Matsuda et al. |
| 6,049,728 A | 4/2000 | Chou et al. |
| 6,727,063 B1 * | 4/2004 | Lander et al. .................. 435/6 |
| 7,223,731 B2 * | 5/2007 | Lawler ........................ 514/12 |
| 7,368,548 B2 * | 5/2008 | Dahary et al. .............. 536/23.1 |
| 2002/0155615 A1 | 10/2002 | Novikov et al. |
| 2003/0118585 A1 | 6/2003 | Muller et al. |
| 2003/0176666 A1 | 9/2003 | Sutcliffe et al. |
| 2004/0054268 A1 | 3/2004 | Esenaliev et al. |
| 2004/0101876 A1 | 5/2004 | Mintz et al. |
| 2004/0127777 A1 | 7/2004 | Ruchti et al. |
| 2004/0142325 A1 | 7/2004 | Mintz et al. |
| 2004/0248157 A1 | 12/2004 | Ayalon-Soffer et al. |
| 2004/0265799 A1 | 12/2004 | Novik et al. |
| 2005/0123538 A1 | 6/2005 | Shemesh et al. |
| 2005/0186600 A1 | 8/2005 | Sella-Tavor et al. |

(Continued)

FOREIGN PATENT DOCUMENTS

EP 125023 11/1984

(Continued)

OTHER PUBLICATIONS

Lawler et al., J. Cell. Biol. 103:1635-1648, 1986.*

(Continued)

*Primary Examiner*—David J Steadman

(57) ABSTRACT

A human thrombospondin 1 protein, polynucleotide encoding the protein, and pharmaceutical composition thereof.

2 Claims, 25 Drawing Sheets

U.S. PATENT DOCUMENTS

| | | |
|---|---|---|
| 2005/0233960 A1 | 10/2005 | Kong-Beltran et al. |
| 2006/0068405 A1 | 3/2006 | Diber et al. |
| 2007/0082337 A1 | 4/2007 | Sorek et al. |

FOREIGN PATENT DOCUMENTS

| | | |
|---|---|---|
| EP | 184187 | 6/1985 |
| EP | 171496 | 2/1986 |
| EP | 173494 | 3/1986 |
| EP | 0519596 | 12/1992 |
| EP | 0770349 | 5/1997 |
| GB | 2322941 | 9/1998 |
| WO | WO 86/01533 | 3/1986 |
| WO | WO 90/02809 | 3/1990 |
| WO | WO 91/00906 | 1/1991 |
| WO | WO 91/06667 | 5/1991 |
| WO | WO 91/10741 | 7/1991 |
| WO | WO 91/17271 | 11/1991 |
| WO | WO 92/01047 | 1/1992 |
| WO | WO 92/03917 | 3/1992 |
| WO | WO 92/03918 | 3/1992 |
| WO | WO 92/09690 | 6/1992 |
| WO | WO 92/15679 | 9/1992 |
| WO | WO 92/18619 | 10/1992 |
| WO | WO 92/20791 | 11/1992 |
| WO | WO 93/01288 | 1/1993 |
| WO | WO 94/10300 | 5/1994 |
| WO | WO 98/55510 | 12/1998 |
| WO | WO 99/18208 | 4/1999 |
| WO | WO 99/51773 | 10/1999 |
| WO | WO 02/12341 | 2/2002 |
| WO | WO 03/020953 | 3/2003 |
| WO | WO 2004/092338 | 10/2004 |
| WO | WO 2004/096979 | 11/2004 |
| WO | WO 2004/096980 | 11/2004 |
| WO | WO 2005/033133 | 4/2005 |
| WO | WO 2005/068618 | 7/2005 |
| WO | WO 2005/071058 | 8/2005 |
| WO | WO 2005/071059 | 8/2005 |
| WO | WO 2005/111634 | 11/2005 |
| WO | WO 2005/113596 | 12/2005 |

OTHER PUBLICATIONS

Chen et al., Mol Cell Prot 1:304-313, 2002.*
Tolsma et al., J. Cell Biol. 122:497-511, 1993.*
Chen et al., Biochemistry 37:9976-9982, 1998.*
"Agencourt_6578352 NIH_MGC_41 *Homo Sapiens* cDNA Clone IMAGE: 5467535 5', mRNA Sequence", Database EMBL 'Online!, Database Accession No. BM556795, 2002.
"Agencourt_785234 NIH_MGC_67 *Homo Sapiens* cDNA Clone IMAGE: 6140098 5', mRNA Sequence", Database EMBL 'Online!, Database Accession No. BU169315, 2002.
"Agencourt_7952308 NIH_MGC_72 *Homo Sapiens* cDNA Clone IMAGE: 6149711 5', mRNA Sequence", Database EMBL 'Online!, Database Accession No. BU171488, 2002.
"OTTHUMP00000031654 (Fragment)", Database EMBL, Database Accession No. Q9BQP0, 2001. Abstract.
Abounader et al. "In Vivo Targeting of SF/HGF and C-Met Expression Via U1snRNA/Ribozymes Inhibits Glioma Growth and Angiogenesis and Promotes Apoptosis", The FASEB Journal, 16: 108-110, 2001.
Adams et al. "Initial Assessment of Human Gene Diversity and Expression Patterns Based Upon 83 Million Nucleotides of cDNA Sequence", Nature, 377(Suppl.): 3-173, Sep. 28, 1995.
Aggarwal "BB Signalling Pathways of the TNF Superfamily: A Double-Edged Sword", Nature Reviews Immunology, 3(9): 745-755, 2003.
Aigner et al. "Expression of A Truncated 100 kDa HER2 Splice Variants Acts as An Endogenous Inhibitor of Tumour Cell Proliferation", Oncogene, 20(17): 2101-2111, 2001.

Akhurst "TGF-β Antagonists: Why Suppress A Tumor Suppressor?", The Journal of Clinical Investigation, 109(12): 1533-1536, 2002.
Altschul et al. "Basic Local Alignment Search Tool", Journal of molecular Biology, 215: 403-410, 1990.
Asadullah et al. "Interleukin-10 Therapy-Review of A New Approach", Pharmacological Review, 55(2): 241-269, 2003.
Attisano et al. "Signal Transduction by the TGF-β Superfamily", Science, 296(5573): 1646-1647, 2002.
Audic et al. "The Significance of Digital Gene Expression Profiles", Genome Research, 7: 986-995, 1997.
Azios et al. "Expression of Herstatin, An Autoinhibitor of HER-2/Neu, Inhibits Transactivation of HER-3 by HER-2 and Blocks EGF Activation of the EGF Receptor", Oncogene, 20(37): 5199-5232, 2001.
Baker et al. "A Randomized Phase 2 Study of the Thrombospondin-Mimetic.Peptide ABT-510 in Patients With Advanced Soft Tissue Sarcoma (STS)", Journal of Clinical Onoclogy, Proceedings of the ASCO Annual Meeting 2005, 23(16 Suppl.): 9013, Jun. 1, 2005. Abstract.
Benson et al. "GenBank", Nucleic Acids Research, 25(1): 1-6, 1997. p. 1-5.
Bieche et al. "Overexpression of BRCA2 Gene in Sporadic Breast Tumours", Oncogen, 18: 5232-5238, 1999.
Bihl et al. "Identification of a Novel IL-6 Isoform Binding to the Endogenous IL-6 Receptor", American Journal of Respiratory Cell and Molecular Biology, 27: 48-56, 2002.
Birchmeier et al. "Met, Metastasis, Motility and More", Nature Reviews: Molecular Cell Biology, 4: 915-925, 2003.
Blazar et al. "Ligation of 4-IBB (CDw137) Regulates Graft-Versus-Host Disease, Graft-Versus-Leukemia, and Graft Rejection in Allogeneic Bone Marrow Transplant Recipients", The Journal of Immunology, 166(5): 3174-3183, 2001.
Boguski "Biosequence Exegesis", Science, 286: 453-455, 1999.
Boguski et al. "ESTablishing A Human Transcript Map", Nature Genetics, 10: 369-371, 1995.
Bonfield et al. "A New DNA Sequence Assembly Program", Nucleic Acids Research, 23(24): 4992-4999, 1995.
Bornstein "Diversity of Function Is Inherent in Matricellular Proteins: An Appraisal of Thrombospondin 1", The Journal of Cell Biology, 130(3): 503-506, Aug. 1995.
Bornstein "Thrombospondins: Structure and Regulation of Expression", The FASEB Journal, 6: 3290-3299, 1992.
Brattain et al. "The Type II Transforming Growth Factor-β Receptor as A Tumor-Suppressor Gene", Current Opinion in Oncology, 8(1): 49-53, 1996.
Brett et al. "EST Comparison Indicates 3.8% of Human mRNAs Contain Possible Alternative Splice Forms", FEBS Letters, 474: 83-86, 2000.
Brierley et al. "IFN-α/β Receptor Interactions to Biologic Outcomes: Understanding the Circuitry", Journal of Interferon and Cytokine Research, 22(8): 835-845, 2002.
Brockmann et al. "Inhibition of Intracerebral Glioblastoma Growth by Local Treatment With the Scatter Factor/Hepatocyte Growth Factor-Antagonist NK4", Clinical Cancer Research, 9: 4578-4585, 2003.
Buetow et al. "High-Throughput Development and Characterization of A Genomewide Collection of Gene-Based Single Nucleotide Polymorphism Markers by Chip-Based Matrix-Assisted Laser Desorption/Ionization Time-of-Flight Masss Spectrometry", Proc. Natl. Acad. Sci. US, 98(2): 581-584, 2001. Esp. p. 581-583 A.
Burgess et al. "Fully Human Monoclonal Antibodies to Hepatocyte Growth Factor With Therapeutic Potential Against Hepatocyte Growth Factor/C-Met-Dependent Human Tumors", Cancer Research, 66(3): 1721-1729, 2006.
Burset et al. "Analysis of Canonical and Non-Canonical Splice Sites in Mammalian Genomes", Nucleic Acids Research, 28(21): 4364-4375, 2000.
Calabretta et al. "Antisense Oligonucleotides Targeting Cooperating Oncogenes", Database GenBank (GenEmbl), Accession No: 196185, 1998. Having 94% Sequence Identity With SEQ ID No: 3. Sequence Alignment.

Camargo et al. "The Contribution of 700,000 ORF Sequence Tags to the Definition of the Human Transcriptome", Proc. Natl. Acad. Sci. USA, 98(21): 12103-12108, 2001.

Caron et al. "The Human Transciptome Map: Clustering of Highly Expressed Genes in Chromosomal Domains", Science, 291: 1289-1292, 2001.

Christensen et al. "A Selective Small Molecule Inhibitor of C-Met Kinase Inhibits C-Met-Dependent Phenotypes In Vitro and Exhibits Cytoreductive Antitumor Activity In Vivo", Cancer Research, 63: 7345-7355, 2003.

Christensen et al. "C-Met as A Target for Human Cancer and Characterization of Inhibitors for Therapeutic Intervention", Cancer Letters, 225: 1-26, 2005.

Chung et al. "Kleisli: A New Tool for Data Integration in Biology", Trends in Biotechnology, TiBTech, 17: 351-355, 1999.

Comoglio et al. "Invasive Growth: From Development to Metastasis", The Journal of Clinical Investigation, 109(7): 857-862, 2002.

Cosenza et al. "Comparative Model Building of Interleukin-7 Using Interleukin-4 as A Template: A Structural Hypothesis That Displays A Typical Surface Chemistry in Helix D Important for Receptor Activation", Protein Science, 9: 916-926, 2000.

Croft "Costimulation of T Cells by OX40, 4-1 BB, and CD27", Cytokine and Growth Factor Reviews, 14(3-4): 265-273, 2003.

Croft "Costimulatory Members of the TNFR Family: Keys to Effective T-Cell Immunity?", Nature Reviews, 3: 609-, 2003.

Croft et al. "ISIS, the Intron Information System, Reveals the High Frequency of Alternative Splicing in the Human Genome", Nature Genetics, 24: 340-341, 2000.

Danilkovitch-Miagkova et al. "Dysregulation of Met Receptor Tyrosine Kinase Activity in Invasive Tumors", The Journal of Clinical Investigation, 109(7): 863-867, 2002.

David et al. "Unusual Alternative Splicing Within the Human Kallikrein Genes KLK2 and KLK3 Gives Rise to Novel Prostate-Specific Proteins", The Journal of Biological Chemistry, 2277(20): 18084-18090; 2002.

Deonarain et al. "Interferon-α/β-Receptor Interactions: A Complex Story Unfolding", Current Pharmaceutical Design, 8(24): 2131-2137, 2002.

Doherty et al. "The HER-2/Neu Receptor Tyrosine Kinase Gene Encodes A Secreted Autoinhibitor", Medical Sciences, 96(19): 10869-10874, 1999.

Dumont et al. "Transforming Growth Factor-β and Breast Cancer: Tumor Promotion Effects of Transforming Growth Factor-β", Breast Cancer Research, 2(2): 125-132, 2000.

Dwight et al. "Saccharomyces Genome Database (SGD) Provides Secondary Gene Annotation Using the Gene Ontology (GO)", Nucleic Acids Research, 30(1): 69-72, 2002.

Etzold et al. "SRS: Information Retrieval System for Molecular Biology Data Banks", Methods in Enzymology, 266(Chap.8): 114-128, 1996.

Fry et al. "Interleukin-7: From Bench to Clinic", Blood, 99(11): 3892-3904, 2002.

Furge et al. "Met Receptor Tyrosine Kinase: Enhanced Signaling Through Adapter Proteins", Oncogene, 19(49): 5582-5589, 2000.

Gasparini et al. "Combination of Antiangiogenic Therapy With Other Anticancer Therapies: Results, Challenges, and Open Questions", Journal of Clinical Oncology, 23: 1295-1311, 2005.

Gebhardt et al. "Differential Expression of Alternatively Spliced C-ErB-2 mRNA in Primary Tumors, Lymph Node Metastases, and Bone Marrow Micrometastases From Breast Cancer Patients", Biochemical and Biophysical Research Communications, 247(2): 319-323, 1998.

Gessner et al. "Biologic Functions and Signaling of the Interleukin-4 Receptor Complexes", Immunobiology, 201 (3-4): 285-307, 1999/2000.

Görgün et al. "Altered Biological Activity Associated With C-Terminal Modifications of IL-7", Cytokine, 20(1): 17-22, 2002.

Haviv et al. "Thrombospondin-1 Mimetic Peptide Inhibitors of Angiogenesis and Tumor Growth: Design, Synthesis, and Optimization of Pharmacokinetics and Biological Activities", Journal of Medicinal Chemsitry, 48(8): 2838-2846, 2005.

Hazkani-Covo et al. "Evolution of Multicellularity in Metazoa: Comparative Analysis of the Subcellular Localization of Proteins in Saccharomyces, Drosophila and Caenorhabditis", Cell Biology International, 28(3): 171-178, 2004.

Heinrich et al. "Principles of Interleukin (IL)-6-Type Cytokine Signalling and Its Regulation", Biochemical Society, 374(Pt 1): 1-20, 2003.

Hillier et al. "Generation and Analysis of 280,000 Human Expressed Sequence Tags", Genome Research, 6: 807-828, 1996.

Hirano "Interleukin 6 and Its Receptor: Ten Years Later", International Reviews in Immunology, 16: 249-284, 1998.

Huang "An Improved Sequence Assembly Program", Genomics, 33: 21-31, 1996.

Huminiecki et al. "In Silico Cloning of Novel Endothelial-Specific Genes", Genome Research, 10: 1796-1806, 2000.

International Human Genome Sequencing Consortium "Initial Sequencing and Analysis of the Human Genome", Nature, 409: 860-921, Feb. 15, 2001.

Jagadeeswaran et al. "C-Met Receptor Tyrosine Kinase: A Novel Molecular Therapeutic Target for the Treatment of Pancreatic Cancer", Proceedings of the American Assciation of Cancer Research, 47: Abstract #3029, 2006. Abstract.

Jones et al. "The Soluble Interleukin 6 Receptor: Mechnisms of Production and Implications in Disease", The FASEB Journal, 15(1): 43-58, 2001.

Karp "Metabolic Databases", Trends in Biochemical Sciences, TiBS, 23: 114-116, 1998.

Kato "Description of the Entire mRNA Population by A 3' End cDNA Fragment Generated by Class IIS Restriction Enzymes", Nucleic Acids Research, 23(18): 3685-3690, 1995.

Kawamoto et al. "BodyMap: A Collection of 3' ESTs for Analysis of Human Gene Expression Information", Genome Research, 10: 1817-1827, 2000.

Kerbel et al. "Antiangiogenic Therapy: A Universal Chemosensitization Strategy for Cancer?", Science, 312(1171): 1171-1175, 2006.

Kerr et al "Small Molecule α(v) Integrin Antagonists: Novel Anticancer Agents", Expert Opinion on Investigative Drugs, 9(6): 1271-1279, 2000.

Kim et al. "Systemic Anti-Hepatocyte Growth Factor Monoclonal Antibody Therapy Induces the Regression of Intracranial Glioma Xenografts", Clinical Cancer Research, 12(4): 1292-1298, 2006.

Knudsen et al. "The Retinoblastoma Tumor Suppressor Inhibits Cellular Proliferation Through Two Distinct Mechanisms: Inhibition of Cell Cycle Progression and Induction of Cell Death", Oncogene, 18(37): 5245-5245, 1999.

Kong-Beltran et al. "The Sema Domain of Met Is Necessary for Receptor Dimerization and Activation", Cancer Cell, 6: 75-84, 2004.

Kotenko "The Family of IL-10-Related Cytokines and Their Receptors: Related, But to What Extent?", Cytokine Growth Factor Reviews, 13(3): 223-240, 2002.

Krawczak et al. "The Mutational Spectrum of Single Base-Pair Substitutions in mRNA Splice Junctions of Human Genes: Causes and Consequences", Human Genetics, 90: 41-54, 1992.

Kwon et al. "4-1BB: Stil in the Midst of Darkness", Molecules and Cells, 10(2): 119-126,2000.

Kwon et al. "Involvement of Tumor Necrosis Factor Receptor Superfamily (TNFRSF) Members in the Pathogenesis of Inflammatory Diseases", Experimental and Molecular Medicine, 35(1): 8-16, 2003.

Kwong et al. "A Novel Splice Variant of HER2 With Increased Transformation Activity", Molecular Carcinogenesis, 23(2): 62-68, 1988.

Lal et al. "Targeting the C-Met Pathway Potentiates Glioblastoma Responses to Gamma-Radiation", Clinical Cancer Research, 11(12): 4479-4486, 2005.

Lawrence et al. "The Genome Reconstruction Manager: A Software Environment for Supporting High-Throughput DNA Sequencing", Genomics, 23: 192-201, 1994.

Liang et al. "Differential Display of Eukaryotic Messenger RNA by Means of the Polymerase Chain Reaction", Science, 257: 967-971, Aug. 14, 1992.

Liu et al. "A Mechanism for Exon Skipping Caused by Nonsense or Missense Mutations in BRCA1 and Other Genes", Nature Genetics, 27: 55-58, 2001.

Loging et al. "Identifying Potential Tumor Markers and Antigens by Database Mining and Rapid Expression Screening", Genome Research, 10: 1393-1402, 2000. Esp. p. 1393-1395.

Ma et al. "A Selective Small Molecule C-Met Inhibitor, PHA665752, Cooperates With Rapamycin", Clinical Cancer Research, 11:2312-2319, 2005.

Ma et al. "C-Met Structure, Functions and Potential for Therapeutic Inhibition", Cancer and Metasasis Reviews, 22: 309-325, 2003.

Mark et al. "Expression and Characterizaton of Hepatocyte Growth Factor Receptor-IgG Fusion Proteins. Effects of Mutations in the Potential Proteolytic Cleavage Site on Processing and Ligand Binding", The Journal of Biological Chemistry, 267(36): 26166-26171, 1992.

Matloubian et al. "A Transmembrane CXC Chemokine Is A Ligand for HIV-Coreceptor Bonzo", Nature Immunology, 1(4): 298-304, 2000.

Maulik et al. "Role of the Hepatocyte Growth Factor Receptor, C-Met, in Oncogenesis and Potential for Therapeutic Inhibition", Cytokine and Growth Factor Reviews, 13(1): 41-59, 2002.

Miao et al. "Thrombospondin-I Type I Repeat Recombinant Proteins Inhibit Tumor Growth Through Transforming Growth Factor-β-Dependent and -Independent Mechanisms", Cancer Research, 61: 7830-7839, Nov. 1, 2001.

Michel et al. "Identification of a Novel IL-6 Isoform Binding to Endogenous IL-6 Receptor", Americanl Journal of Respiratory Cell and Molecular Biology, 27: 48-56, 2002.

Michieli et al. "Mutant Met-Mediated Transformation Is Ligand-Dependent and Can Be Inhibited by HGF Antagonists", Oncogene, 18: 5221-5231, 1999.

Michieli et al. "Targeting the Tumor and Its Microenvironment by Dual-Function Decoy Met Receptor", Cancer Cell, 6:61-73, 2004.

Miyazono "TGF-β Receptors and Signal Transduction", International Journal of Hematology, 65(2): 97-104, 1997.

Moore et al. "Interleukin-10 and the Interleukin-10 Receptor", Annual Reviews in Immunology, 19: 683-765, 2001.

Mould et al. "Molecular Basis of Ligand Recognition by Integrin α5β1. I. Specificity of Ligand Binding Is Determined by Amino Acid Sequences in the Second and Third NH2-Terminal Repeats of the α Subunit", The Journal of Biological Chemistry, 275(27): 20324-20336, 2000.

Moustakas et al. "Smad Regulation in TGF-β Signal Transduction", Journal of Cell Science, 114(Pt.24): 4359-4369, 2001.

Mueller et al. "Structure Binding, and Antagonists in the IL-4/IL-13 Receptor System", Biochimica et Biophysica Acta, 1592(3): 237-250, 2002.

Muneer et al. "Genomic Organization and Mapping of the Gene Encoding the PP2A B56γ Regulatory Subunit", Genomics, 79(3): 344-348, 2002.

Nahta et al. "Growth Factor Receptors in Breast Cancer: Potential for Therapeutic Intervention", The Oncologist, 8(1): 5-17, 2003.

Naka et al. "The Paradigm of IL-6: From Basic Science to Medicine", Arthritis Research, 4(Suppl.3): S233-S242, 2002. Review.

NCBI The NCBI News, p. 1-18, 1996.

Needleman et al. "A General Method Applicable to the Search for Similarities in the Amino Acid Sequence of Two Proteins", Journal of Molecular Biology, 48: 443-453, 1970.

Nelms et al. "The IL-4 Recptor: Signalling Mechnisms and Biologic Functions", Annual Reviews of Immunology, 17: 701-738, 1999.

Okamoto et al. "UbcH10 Is the Cancer-Related E2 Ubiquitin-Conjugating Enzyme", Cancer Research, 63(14): 4167-4173, 2003.

Pan et al. "IL-4 Receptor Mutations", Current Opinion in Immunology, 11(6): 615-620, 1999.

Park et al. "*Homo Sapiens* mRNA for Met Proto-Oncogene", Database GenBank (GenEmbl), Accession No: X54559, 1999. Having 96.1% Sequence Identity With SEQ ID No: 3. Sequence Alignment.

Park et al. "Sequence of MET Protooncogene cDNA Has Features Characteristic of the Tyrosine Kinase Family of Growth-Factor Receptors", Proc. Natl. Acad. Sci. USA, 84: 6379-6383, 1987.

Pearson et al. "Improved Tools for Biological Sequence Comparison", Proc. Natl. Acad. Sci. USA, 85: 2444-2448, Apr. 1988.

Reeck et al. "Homology' in Proteins and Nucleic Acids: A Terminology Muddle and A Way Out of It", Cell, 50: 667, 1987.

Rodriguez-.Tomé et al. "The European Bioinformatics Institute (EBI) Databases", Nucleid Acids Research, 24(1): 6-12, 1996.

Saimura et al. "Intraperitoneal Injection of Adenovirus-Mediated NK4 Gene Suppresses Peritoneal Dissemination of Pancreatic Cancer Cell Line AsPC-1 in Nude Mice", Cancer Gene Therapy, 9: 799-806, 2002.

Sargiannidou et al. "Mechanisms of Thrombospondin-1-Mediated Metastasis and Angiogenesis", Seminars in Thrombosis and Hemostasis, 30(1): 127-136, 2004.

Sazani et al. "Modulation of Alternative Splicing by Antisense Oligonucleotides", Progress in Molecular and Subcellular Biology, 31: 217-239, 2003.

Schena et al. "Quantitative Monitoring of Gene Expression Patterns With A Complementary DNA Microarray", Science, 270: 467-470, 1995.

Schlegel et al. "Human Cervical Cancer Cell Marker Protein SEQ ID NO: 228", Database Geneseq 'Online!, Database Accession No. ABR92159, 2003. & WO 02/101075, 2002.

Schröder et al. "Isolation of a cDNA Encoding the Human GM2 Activator Protein", FEBS Letters, 251(1,2): 197-200, 1989.

Schuler et al. "Entrez: Molecular Biology Database and Retrieval System", Methods in Enzymology, 266: 141-162, 1996.

Seo et al. "Blocking 4-IBB/4-IBB Ligand Interactions Prevents Herpetic Stromal Keratitis", The Journal of Immunology, 171(2): 576-583, 2003.

Short et al. "Inhibition of Endothelial Cell Migration by Thrombospondin-1 Type-1 Repeats Is Mediated by β1 Integrins", The Journal of Cell Biology, 168(4): 643-653, Feb. 14, 2005.

Shoshan et al. "Designing Oligo Libraries Taking Alternative Splicing Into Account", Proceedings of SPIE, 4266: 86-95, 2001.

Sid et al. "Thrombospondin 1: A Multifunctional Protein Implicated in the Regulation of Tumor Growth", Critical Reviews in Oncology/Hematology, 49: 245-258, 2004.

Simpson et al. "Interleukin-6: Structure-Function Relationships", Protein Science, 6: 929-955, 1997.

Smith et al. "Comparison of Biosequences", Advances in Applied Mathematics, 2: 482-489, 1981.

Strausberg et al. "*Homo Sapiens* Ubiquitin-Conjugating Enzyme E2C, mRNA (cDNA Clone Image: 5574059), Partial Cds", Database EMBL 'Online! Database Accession No. BC032677, 2202. See: "Generation and Initial Analysis of More Than 15,000 Full-Length Human and Mouse cDNA Sequences", Proc. Natl. Acad. Sci. USA, 99(26): 16899-16903, 2002.

Sutton et al. "TIGR Assembler: A new Tool for Assembling Large Shotgun Sequencing Projects", Genome Science & Technology, 1(1): 9-19, 1995.

Swindell et al. "SEQMAN. Contig Assembly", Methods in Molecular Biology, 70: 75-89, 1997.

To et al. "The Roles of Hepatocyte Growth Factor/Scatter Factor and Met Receptor in Human Cancers (Review)", Oncology Reports, 5(5): 1013-1024, 1998.

Tomioka et al. "Inhibition of Growth, Invasion, and Metastasis of Human Pancreatic Carcinoma Cells by NK4 in An Orthotopic Mouse Model", Cancer Research, 61: 7518-7524, 2001.

Townsley et al. "Dominant-Negative Cyclin-Selective Ubiquitin Carrier Protein E2-C/UBCH10 Blocks Cells in Metaphase", Proc. Natl. Acad. Sci. USA, 94(6): 2362-2367, 1997.

Trusolino et al. "Interactions Between Scatter Factors and Their Receptors: Hints for Therapeutic Applications", The FASEB Journal, 12(3): 1267-1280, 1998.

Tucker "αv Integrin Inhibitors and Cancer Therapy", Current Opinion in Investigational Drugs, 4(6): 722-731, 2003.

Tullo et al. "Reorganization and Merging of the EMBL and GenBank Keyword Indexes in A Tree Structure for More Efficient Retrieval or Nucleic Acid Sequences", Protein Sequences and Data Analysis, 3: 327-334, 1990.

VanderSpek et al. "Structure Function Analysis of Interleukin 7: Requirement for An Aromatic Ring at Position 143 of Helix D", Cytokine, 17(5): 227-233, 2002.

Velculescu et al. "Serial Analysis of Gene Expression", Science, 270: 484-487, 1995.

Vinay et al. "Role of 4-1 BB in Immune Responses", Seminars in Immunology, 10(6): 481-489, 1998.
Wajih et al. "Vascular Origin of Soluble Truncated Form of the Hepatocyte Growth Factor Receptor (C-Met)", Circulation Research, 90(1): 46-52, 2002.
Walter "Structure of Interleukin-10/Interleukin-10R1 Complex: A Paradigm for Class 2 Cytokine Activation", Immunologic Research, 26(1-3): 303-308, 2002.
Webb et al. "The Gelanamycins Are Potent Inhibitors of the Hepatocyte Growth Factor/Scatter Factor-Met-Urokinase Plasminogen Activator-Plasmin Proteolytic Network", Cancer Research, 60: 342-349, 2000.
Welsh et al. "Arbitrarily Primed PCR Fingerprinting of RNA", Nucleic Acids Research, 20(19): 4965-4970, 1992.
Wickramasinghe et al. "Met Activation and Receptor Dimerization in Cancer", Cell Cycle, 4(5): 683-685, 2005.
Wrana "TGF-β Receptors and Signaling Mechanisms", Mineral and Electrolyte Metabolism, 24(2-3): 120-130, 1998.
Younes et al. "Labelled Oligonucleotides as Radiopharmaceuticals: Pitfalls, Problems and Perspectives", Current Pharmaceutical Design, 8: 1451-1466, 2002.
Zhang et al. "HGF/SF-Met Signaling of the Control of Branching Morphogenesis and Invasion", Journal of Cellular Biochemistry, 88(2): 408-417, 2003.
Zhang et al. "Met Decoys: Will Cancer Take the Bait?", Cancer Cell, 6: 5-6, 2004.
International Preliminary Report on Patentability Dated Oct. 18, 2007 From the International Bureau of WIPO Re.: Application No. PCT/IL2005/000106.
International Preliminary Report on Patentability Dated of Aug. 3, 2006 From the International Bureau of WIPO Re.: Application No. PCT/IL2004/000078.
Invitation to Pay Additional Fees Dated Apr. 27, 2007 From the International Searching Authority Re.: Application No. PCT/IL05/00106.
Official Action Dated Mar. 22, 2007 From the US Patent and Trademark Office Re.: U.S. Appl. No. 10/764,833.
Arumugam et al. "The Role of the Complement System in Ischemia-Reperfusion Injury", Shock, 21(5): 401-409, 2004.
Capasso et al. "Costimulation Via CD55 on Human CD4+ T Cells Mediated by CD97", The Journal of Immunology, 177: 1070-1077, 2006.
Caras et al. "Cloning of Decay-Accelerating Factor Suggests Novel Use of Splicing to Generate Two Proteins", Nature, 325: 545-549, Feb. 5, 1987.
Durrant et al. "Enhanced Expression of the Complement Regulatory Protein CD55 Predicts a Poor Prognosis in Colorectal Cancer Patients", Cancer Immunology & Immunotherapy, 52: 638-642, 2003.
Ghebremariam et al. "Internvention Strategies and Agents Mediating the Prevention of Xenorejection", Annals of the New York Academy of Sciences, 1056: 123-143, 2005.
Harris et al. "Coupling Complement Regulators to Immunoglobulin Domains Generates Effective Anti-Complement Reagents With Extended Half-Life in Vivo", Clinical and Experimental Immunology, 129: 198-207, 2002.
Harris et al. "Molecular and Functional Analysis of Mouse Decay Accelerating Factor (CD55)", Biochemical Journal, 341: 821-829, 1999.
Kim et al. "Membrane Complement Regulatory Proteins", Clinical Immunology, 118: 127-136, 2006.
Kop et al. "CD97 Neutralisation Increases Resistance to Collagen-Induced Arthritis in Mice", Arthritis Research & Thearpy, 8(5/R155): 1-11, 2006.
Leemans et al. "The Epidermal Growth Factor-Seven Transmembrane (EGF-TM7) Receptor CD97 Is Required for Neutropyhil Migration and Host Defense", The Journal of Immunology, 172: 1125-1131, 2004.
Liu et al. "The Complement Inhibitory Protein DAG (CD55) Suppresses T Cell Immunity in Vivo", The Journal of Experimental Medicine, 201(4): 567-577, Feb. 21, 2005.
Longhi et al. "Holfing T Cells in Check—A New Role for Complement Regulators?", Trends in Immunology, 27(2): 102-108, Feb. 2006.
Lublin "Review: Cromer and DAF: Role in Health and Disease", Immunohematology, 21(2): 39-47, 2005.
Macor et al. "In Vivo Targeting of Human Neutralizing Antibodies Against CD55 and CD59 to Lymphoma Cells Increases the Antitumor Activity of Rituximab", Cancer Research, 67(21): 10556-10563, Nov. 1, 2007.
Maxwell-Armstrong "Studies Using the Anti-Idiotypic Monoclonal Antibody 105AD7 in Patients With Primary and Advanced Colorectal Cancer", Annals of the Royal College of Surgeons of England, 84: 314-318, 2002.
Mikesch et al. "Decay-Accelerating Factor (CD55): A Versatile Acting Molecule in Human Malignancies", Biochimica et Biophysica Acta, 1766: 42-52, 2006.
Mikesch et al. "The Expression and Action of Decay-Accelerating Factor (CD55) in Human Malignancies and Cancer Therapy", Cellular Oncology, 28: 223-232, 2006.
Miwa et al. "Alternative Exon Usage in the 3' Region of A Single Gene Generates Glycosylphosphatidylinositol-Achored and Transmembrane Forms of Rat Decay-Acdelerating Factor", Immunogenetics, 51: 129-137, 2000.
Moran et al. "Human Recombinant Soluble Decay Accelerating Factor Inhibits Complement Activation In Vitro and In Vivo", The Journal of Immunology, 149(5): 1736-1743, Sep. 1, 1992.
Nonaka et al. "Multiple Isoforms of Guinea Pig Decay-Accelerating Factor (DAF) Generated by Alternative Splicing", The Journal of Immunology, 155: 3037-3048, 1995.
Osuka et al. "Moleuclar Cloning and Characterization of Novel Splicing Variants of Human Decay-Accelerating Factor", Genomics, 88: 316-322, 2006.
Pritchard-Jones et al. "Immune Responses to the 105AD7 Human Anti-Idiotypic Vaccine After Intensive Chemotherapy, for Osteosarcoma", British Journal of Cancer, 92: 1358-1365, 2005.
Spendlove et al. "Complement Decay Accelerating Factor (DAF)/CD55 in Cancer", Cancer Immunology and Immunotherapy, 55: 987-995, 2006.
Ullenhag et al. "A Neoadjuvant/Adjuvant Randomized Trial of Colorectal Cancer Patients Vaccinated With An Anti-Idiotypic Antibody, 105AD7, Mimicking CD55", Clinical Cancer Research, 12(24): 7389-7396, Dec. 15, 2006.
Weeks et al. "Decay-Accelerating Factor Attenuates Remote Ischemia-Reperfusion-Initiated Organ Damage", Clinical Immunology, 124: 311-327, 2007.
Supplementary European Search Report Dated May 19, 2009 From the European Patent Office Re.: Application No. 05703149.4.
Duan et al. "101 Human Secretory Proteins", Database EMBL [Online], XP002522082, Retrieved From EBI Acccssion No. EMBL:BD078424, Databasc Accession No. BD078424, Sep. 4, 2002. Abstract.
Neto et al. "MR2-MT0127-290800-001-e07 MT0127 Homo Sapiens cDNA, mRNA Sequence", Database EMBL [Online], XP002522080, Retrieved From EBI Accession No. EMBL:BE935880, Database Accession No. BE935603, Oct. 5, 2000. Abstract.
Neto et al. "QV2-NN0045-300800-344-H05-NN0045 Homo Sapiens cDNA, mRNA Sequence", Database EMBL [Online], XP002522081, Retrieved From EBI Accession No. EMBL:BE935880, Database Accession No. BE935880, Oct. 5, 2000. Abstract.
Neto et al. "Shotgun Sequencing of the Human Transcriptome With ORF Expressed Sequence Tags", Proc. Natl. Acad. Sci. USA, XP002944162, 97(7): 3491-3496, Mar. 28, 2000.

* cited by examiner

Figure 4 (page 1/9)

1 tumor

*1.1 epithelial cell tumors*

1.1.1 carcinoma 1.1.1.1 adenocarcinoma 1.1.1.2 lobullar carcinoma

*1.2 Mesenchimal cell tumors*

1.2.1 sarcoma 1.2.1.1 liposarcoma 1.2.1.2 rhabdomyosarcoma 1.2.1.3 pnet 1.2.1.4 ewing sarcoma

*1.3 blood tumors*

1.3.1 lymphoma 1.3.2 leukemia 1.3.3 myeloma

*1.4 endocrine tumors*

1.4.1 pheocromocytoma 1.4.2 carcinoid

Figure 4 (page 2/9)

2 endocrine system

*2.1 adrenal*

2.1.1 pheocromocytoma

*2.2 pancreas*

2.2.1 islets of Langerhans

*2.3 neuroendocrine*

2.3.1 hypothalamus 2.3.2 carcinoid

*2.4 thyroid*

3 vascular tissue

*3.1 arteries*

3.1.1 aorta

*3.2 vein*

Figure 4 (page 3/9)

4 genitourinary system

*4.1 urinary system*

4.1.1 bladder 4.1.2 kidney

*4.2 genital system*

4.2.1 women genital system 4.2.1.1 cervix 4.2.1.2 ovary 4.2.1.3 uterus

*4.2.1.3.1 endometrium*

4.2.2 men gentile system 4.2.2.1 prostate 4.2.2.2 testis

*4.2.2.2.1 epididymis*

5 muscles

*5.1 rhabdomyosarcoma*

*5.2 tongue*

*5.3 bladder*

*5.4 heart*

*5.5 uterus*

Figure 4 (page 4/9)

6 Blood

*6.1 peripheral blood*

6.1.1 erythroid line

6.1.2 leukocyte

6.1.2.1 lymphoid system

*6.1.2.1.1 lymphoma*

*6.1.2.1.2 spleen*

*6.1.2.1.3 thalamus*

*6.2 stem cells*

6.2.1 myeloid

6.2.2 myeloma

*6.3 Bone marrow*

*6.4 leukemia*

Figure 4 (page 5/9)

7 nerve system

*7.1 CNS, central nervous system*

7.1.1 brain 7.1.1.1 cerebrum 7.1.1.2 cerebellum 7.1.1.3 pitituary gland 7.1.1.4 hypothalamus 7.1.1.5 thalamus 7.1.1.6 olfactory 7.1.1.7 Hippocampus 7.1.1.8 amygdala 7.1.1.9 frontal lobe 7.1.1.10    pnet

*7.2 Embryonal nerve system*

7.2.1 primitive neuroectoderm

*7.3 retina*

7.3.1 retinoblastoma

Figure 4 (page 6/9)

8 breast

*8.1 ductal breast*

8.1.1 ductal carcinoma

*8.2 lobullar carcinoma*

*8.3 mammary*

9 skeleton

*9.1 bone*

9.1.1 ewing sarcoma 9.1.2 craniofacial 9.1.2.1 calvarium

*9.2 connective tissue*

9.2.1 trabeculae 9.2.2 cartilage

10 embryo

*10.1 amnion*

*10.2 chorion*

*10.3 primitive neuroectoderm*

*10.4 placenta*

Figure 4 (page 7/9)

11 exocrine system

*11.1 pancreas*

11.1.1 islets of Langerhans

*11.2 prostate*

*11.3 salivary gland*

Figure 4 (Page 8/9)

12 face organs

*12.1 nose*

*12.2 ear*

12.2.1    cochlea

*12.3 eye*

12.3.1    retina 12.3.1.1    retinoblastoma 12.3.2    lens

*12.4 mouth*

*12.5 tongue*

13 gastrointestinal system

*13.1 mucosa*

*13.2 stomach*

*13.3 intestine*

13.3.1    colorectal 13.3.1.1    colon

*13.4 hepatobiliary system*

13.4.1    liver 13.4.2    biliary system 13.4.2.1    gall bladder

*13.5 pancreas*

13.5.1    islets of Langerhans

Figure 4 (page 9/9)

14 respiratory system

*14.1 nasopharynx*

*14.2 lung*

14.2.1      small cell lung carcinoma

15 skin

*15.1 dermis*

15.1.1      melanocyte

16 fat tissue

*16.1 liposarcoma*

HUMAN THROMBOSPONDIN POLYPEPTIDE

RELATED APPLICATIONS

This application is a continuation of U.S. patent application Ser. No. 10/242,799, filed on Sep. 13, 2002, now abandoned, which claims the benefit of U.S. Provisional Patent Application Nos. 60/322,285, filed on Sep. 14, 2001; 60/354,242, filed on Feb. 6, 2002; 60/371,494, filed on Apr. 11, 2002 and 60/384,096, filed on May 31, 2002. The contents of the above Applications are all incorporated herein by reference.

FIELD AND BACKGROUND OF THE INVENTION

The present invention relates to systems and methods useful for annotating biomolecular sequences. More particularly, the present invention relates to computational approaches, which enable systemic characterization of biomolecular sequences and identification of differentially expressed biomolecular sequences such as sequences associated with a pathology.

In the postgenomic era, data analysis rather than data collection presents the biggest challenge to biologists. Efforts to ascribe biological meaning to genomic data, whether by identification of function, structure or expression pattern are lagging behind sequencing efforts [Boguski M S (1999) Science 286:453-455].

It is well recognized that elucidation of spatial and temporal patterns of gene expression in healthy and diseased states may contribute immensely to further understanding of disease mechanisms.

Therefore, any observational method that can rapidly, accurately and economically observe and measure the pattern of expression of selected individual genes or of whole genomes is of great value to scientists.

In recent years, a variety of techniques have been developed to analyze differential gene expression. However, current observation and measurement methods are inaccurate, time consuming, labor intensive or expensive, oftentimes requiring complex molecular and biochemical analysis of numerous gene sequences.

For example, observation methods for individual mRNA or cDNA molecules such as Northern blot analysis, RNase protection, or selective hybridization to arrayed cDNA libraries [see Sambrook et al. (1989) Molecular cloning, A laboratory manual, Cold Spring Harbor press, NY] depend on specific hybridization of a single oligonucleotide probe complementary to the known sequence of an individual molecule. Since a single human cell is estimated to express 10,000-30,000 genes [Liang et al. (1992) Science 257:967-971], single probe methods to identify all sequences in a complex sample are ineffective and laborious.

Other approaches for high throughput analysis of differential gene expression are summarized infra.

EST sequencing—The basic idea is to create cDNA libraries from tissues of interest, pick clones randomly from these libraries and then perform a single sequencing reaction from a large number of clones. Each sequencing reaction generates 300 base pairs or so of sequence that represents a unique sequence tag for a particular transcript. An EST sequencing project is technically simple to execute since it requires only a cDNA library, automated DNA sequencing capabilities and standard bioinformatics protocols.

To generate meaningful amounts of data, however, high throughput template preparation, sequencing and analysis protocols must be applied. As such, the number of new genes identified as well as the statistical significance of the data is proportional to the number of clones sequenced as well as the complexity of the tissue being analyzed [Adams et al. (1995) Nature 377:3-173; Hillier et al. (1996) Genome Res. 6:807-828].

Subtractive cloning—Subtractive cloning offers an inexpensive and flexible alternative to EST sequencing and cDNA array hybridization. In this approach, double-stranded cDNA is created from the two-cell or tissue populations of interest, linkers are ligated to the ends of the cDNA fragments and the cDNA pools are then amplified by PCR. The cDNA pool from which unique clones are desired is designated the "tester", and the cDNA pool that is used to subtract away shared sequences is designated the "driver". Following initial PCR amplification, the linkers are removed from both cDNA pools and unique linkers are ligated to the tester sample. The tester is then hybridized to a vast excess of driver DNA and sequences that are unique to the tester cDNA pool are amplified by PCR.

The primary limitation of subtractive methods is that they are not always comprehensive. The cDNAs identified are typically those, which differ significantly in expression level between cell-populations and subtle quantitative differences are often missed. In addition each experiment is a pair wise comparison and since subtractions are based on a series of sensitive biochemical reactions it is difficult to directly compare a series of RNA samples.

Differential display—Differential display is another PCR-based differential cloning method [Liang and Pardee (1992) Science 257:967-70; Welsh et al. (1992) Nucleic Acids Res. 20:4965-70]. In classical differential display, reverse transcription is primed with either oligo-dT or an arbitrary primer. Thereafter an arbitrary primer is used in conjunction with the reverse transcription primer to amplify cDNA fragments and the cDNA fragments are separated on a polyacrylamide gel. Differences in gene expression are visualized by the presence or absence of bands on the gel and quantitative differences in gene expression are identified by differences in the intensity of bands. Adaptation of differential display methods for fluorescent DNA sequencing machines has enhanced the ability to quantify differences in gene expression [Kato (1995) Nucleic Acids Res. 18:3685-90].

A limitation of the classical differential display approach is that false positive results are often generated during PCR or in the process of cloning the differentially expressed PCR products. Although a variety of methods have been developed to discriminate true from false positives, these typically rely on the availability of relatively large amounts of RNA.

Serial analysis of gene expression (SAGE)—this DNA sequence based method is essentially an accelerated version of EST sequencing [Valculescu et al. (1995) Science 270:484-8]. In this method a digestible unique sequence tag of 13 or more bases is generated for each transcript in the cell or tissue of interest, thereby generating a SAGE library.

Sequencing each SAGE library creates transcript profiles. Since each sequencing reaction yields information for twenty or more genes, it is possible to generate data points for tens of thousands of transcripts in modest sequencing efforts. The relative abundance of each gene is determined by counting or clustering sequence tags. The advantages of SAGE over many other methods include the high throughput that can be achieved and the ability to accumulate and compare SAGE tag data from a variety of samples, however the technical difficulties concerning the generation of good SAGE libraries and data analysis are significant.

Altogether, it is clear from the above that laboratory bench approaches are ineffective, time consuming, expensive and often times inaccurate in handling and processing the vast amount of genomic information which is now available.

It is appreciated, that much of the analysis can be effected by developing computational algorithms, which can be applied to mining data from existing databases, thereby retrieving and integrating valuable biological information.

To date, there are more than a hundred major biomolecule databases and application servers on the Internet and new sites are being introduced at an ever-increasing rates [Ashburner and Goodman (1997) Curr. Opin. Genet. Dev. 7:750-756; Karp (1998) Trends Biochem. Sci. 23:114-116].

However, these databases are organized in extremely heterogeneous formats. These reflect the inherent complexity of biological data, ranging from plain-text nucleic acid and protein sequences, through the three dimensional structures of therapeutic drugs and macromolecules and high resolution images of cells and tissues, to microarray-chip outputs. Moreover data structures are constantly evolving to reflect new research and technology development.

The heterogeneous and dynamic nature of these biological databases present major obstacles in mining data relevant to specific biological queries. Clearly, simple retrieval of data is not sufficient for data mining; efficient data retrieval requires flexible data manipulation and sophisticated data integration. Efficient data retreival requires the use of complex queries across multiple heterogeneous data sources; data warehousing by merging data derived from multiple public sources and local (i.e., private) sources; and multiple data-analysis procedures that require feeding subsets of data derived from different sources into various application programs for gene finding, protein-structure prediction, functional domain or motif identification, phylogenetic tree construction, graphic presentation and so forth.

Current biological data retrieval systems are not fully up to the demand of smooth and flexible data integration [Etzold et al. (1996) Methods Enzymol 266:t14-t28; Schuler et al. (1996) Methods Enzymol. 266:141-162; Chung and Wong (1999) Trends Biotech. 17:351-355].

There is thus a widely recognized need for, and it would be highly advantageous to have, systems and methods which can be used for efficient retrieval and processing of data from biological databases thereby enabling annotation of previously un-annotated biomolecular sequences.

SUMMARY OF THE INVENTION

According to one aspect of the present invention there is provided a method of annotating biomolecular sequences according to a hierarchy of interest, the method comprising: (a) computationally constructing a dendrogram having multiple nodes, the dendrogram representing the hierarchy of interest, wherein each node of the multiple nodes of the dendrogram is annotated by at least one keyword; (b) computationally assigning each biomolecular sequence of the biomolecular sequences to a specific node of the multiple nodes of the dendrogram to thereby generate assigned biomolecular sequences; and (c) computationally classifying each of the assigned biomolecular sequences to nodes hierarchically higher than the specific node, thereby annotating biomolecular sequences according to the hierarchy of interest.

According to another aspect of the present invention there is provided a method of identifying differentially expressed biomolecular sequences, the method comprising: (a) computationally constructing a dendrogram having multiple nodes, the dendrogram representing the hierarchy of interest, wherein each node of the multiple nodes of the dendrogram is annotated by at least one keyword; (b) computationally assigning each biomolecular sequence of the biomolecular sequences to a specific node of the multiple nodes of the dendrogram to thereby generate assigned biomolecular sequences; (c) computationally classifying each of the assigned biomolecular sequences to nodes hierarchically higher than the specific node, to thereby generate annotated biomolecular sequences; and (d) identifying annotated biomolecular sequences assigned to a portion of the multiple nodes, thereby identifying differentially expressed biomolecular sequences.

According to yet another aspect of the present invention there is provided a computer readable storage medium comprising a database stored in a retrievable manner, the database including files each containing data of a specific node of a dendrogram, the data including biomolecular sequence information and biomolecular sequence annotations, wherein the biomolecular sequence annotations are selected from the group consisting of contig description, tissue specific expression, pathological specific expression, functional features, parameters for ontological annotation assignment, cellular localization, database sequence source and functional alterations.

According to still another aspect of the present invention there is provided a system for generating a database of annotated biomolecular sequences, the system comprising a processing unit, the processing unit executing a software application configured for: (a) constructing a dendrogram having multiple nodes, the dendrogram representing a hierarchy of interest, wherein each node of the multiple nodes of the dendrogram is annotated by at least one keyword; (b) assigning each biomolecular sequence of the biomolecular sequences to a specific node of the multiple nodes of the dendrogram to thereby generate assigned biomolecular sequences; (c) classifying each of the assigned biomolecular sequences to nodes hierarchically higher than the specific node, to thereby generate annotated biomolecular sequences; and (d) storing sequence annotations and sequence information of the annotated biomolecular sequences, thereby generating the database of annotated biomolecular sequences.

According to further features in preferred embodiments of the invention described below, the biomolecular sequences are selected from the group consisting of polypeptide sequences and polynucleotide sequences.

According to still further features in the described preferred embodiments the polynucleotides are selected from the group consisting of genomic sequences, expressed sequence tags, contigs, complementary DNA (cDNA) sequences, pre-messenger RNA (mRNA) sequences, and mRNA sequences.

According to still further features in the described preferred embodiments the biomolecular sequences are selected from the group consisting of annotated biomolecular sequences, unannotated biomolecular sequences and partially annotated biomolecular sequences.

According to still further features in the described preferred embodiments the method further comprising homology clustering of the biomolecular sequences prior to step (b).

According to still further features in the described preferred embodiments the dendrogram is selected from the group consisting of a graph, a list, a map and a matrix.

According to still further features in the described preferred embodiments the hierarchy of interest is selected from the group consisting of a tissue expression hierarchy, a developmental expression hierarchy, a pathological expression hierarchy, a cellular expression hierarchy, an intracellular expression hierarchy, a taxonomical hierarchy and a functional hierarchy.

According to still further features in the described preferred embodiments each node of the multiple nodes is a parental node in an additional hierarchy of interest.

According to still further features in the described preferred embodiments the method further comprising classifying the biomolecular sequences of the parental node according to the additional hierarchy of interest.

According to still further features in the described preferred embodiments the system further comprising classifying the biomolecular sequences of the parental node according to the additional hierarchy of interest.

According to still further features in the described preferred embodiments each of the biomolecular sequences is a member of a sequence contig.

According to still further features in the described preferred embodiments the method further comprising the step of confirming annotations of the assigned biomolecular sequence in-vivo and/or in-vitro prior to or following step (c).

According to still further features in the described preferred embodiments the system further comprising the step of confirming annotations of the assigned biomolecular sequence in-vivo and/or in-vitro prior to or following step (c).

According to an additional aspect of the present invention there is provided a method of identifying sequence features unique to differentially expressed mRNA splice variants, the method comprising: (a) computationally identifying unique sequence features in each splice variant of an alternatively spliced expressed sequences; and (b) identifying differentially expressed splice variants of the alternatively spliced expressed sequences, thereby identifying sequence features unique to differentially expressed mRNA splice variants.

According to yet an additional aspect of the present invention there is provided a computer readable storage medium comprising data stored in a retrievable manner, the data including sequence information of sequence features unique to differentially expressed mRNA splice variants as set forth in files:
 "Transcripts_nucleotide_seqs_part1",
 "Transcripts_nucleotide_seqs_part2"
 "Transcripts_nucleotide_seqs_part3.new" and/or
 "Protein.seqs"
provided in CD-ROMs 1 and/or 2 enclosed herewith, and sequence annotations as set forth in annotation categories "#TAA_CD" and "#TAA_TIS", in the file "Summary_table.new" of CD-ROM3 enclosed herewith.

According to still an additional aspect of the present invention there is provided a system for generating a database of sequence features unique to differentially expressed mRNA splice variants, the system comprising a processing unit, the processing unit executing a software application configured for: (a) identifying unique sequence features in each splice variant of an alternatively spliced expressed sequences; and (b) identifying differentially expressed splice variants of the alternatively spliced expressed sequences, thereby identifying sequence features unique to differentially expressed mRNA splice variants. (c) storing the sequence features unique to the differentially expressed mRNA splice variants, thereby generating the database of sequence features unique to differentially expressed mRNA splice variants.

According to still further features in the described preferred embodiments step (b) is effected by qualifying annotations associated with the alternatively spliced expressed sequences.

According to still further features in the described preferred embodiments the method further comprising scoring the annotations associated with the alternatively spliced expressed sequences according to: (i) prevalence of the alternatively spliced expressed sequences in normal tissues; (ii) prevalence of the alternatively spliced expressed sequences in pathological tissues; (iii) prevalence of the alternatively spliced expressed sequence in total tissues; and (iv) number of tissues and/or tissue types expressing the alternatively spliced expressed sequences;

According to still further features in the described preferred embodiments the system further comprising scoring the annotations associated with the alternatively spliced expressed sequences according to: (i) prevalence of the alternatively spliced expressed sequences in normal tissues; (ii) prevalence of the alternatively spliced expressed sequences in pathological tissues; (iii) prevalence of the alternatively spliced expressed sequence in total tissues; and (iv) number of tissues and/or tissue types expressing the alternatively spliced expressed sequences;

According to still further features in the described preferred embodiments step (b) is effected by identifying the unique sequence feature.

According to still further features in the described preferred embodiments the unique sequence feature is selected from the group consisting of a donor-acceptor concatenation, an alternative exon, an exon and a retained intron.

According to still further features in the described preferred embodiments identifying unique sequence features in each splice variant of an alternatively spliced expressed sequence is effected by expressed sequence alignment.

According to a further aspect of the present invention there is provided a kit useful for detecting differentially expressed polynucleotide sequences, the kit comprising at least one oligonucleotide being designed and configured to be specifically hybridizable with a polynucleotide sequence selected from the group consisting of sequence files:
 "Transcripts_nucleotide_seqs_part1"
 "Transcripts_nucleotide_seqs_part2" and
 "Transcripts_nucleotide_seqs_part3.new"
provided in CD-ROMs 1 and/or 2 enclosed herewith, under moderate to stringent hybridization conditions.

According to still further features in the described preferred embodiments the at least one oligonucleotide is labeled.

According to still further features in the described preferred embodiments the at least one oligonucleotide is attached to a solid substrate.

According to still further features in the described preferred embodiments the solid substrate is configured as a microarray and whereas the at least one oligonucleotide includes a plurality of oligonucleotides each being capable of hybridizing with a specific polynucleotide sequence of the polynucleotide sequences set forth in the files:
 "Transcripts_nucleotide_seqs_part1"
 "Transcripts_nucleotide_seqs_part2" and/or
 "Transcripts_nucleotide_seqs_part3.new"
provided in CD-ROMs 1 and/or 2 enclosed herewith.

According to still further features in the described preferred embodiments each of the plurality of oligonucleotides is being attached to the microarray in a regio-specific manner.

According to still further features in the described preferred embodiments the at least one oligonucleotide is designed and configured for DNA hybridization.

According to still further features in the described preferred embodiments the at least one oligonucleotide is designed and configured for RNA hybridization.

According to yet a further aspect of the present invention there is provided a method of annotating biomolecular sequences, the method comprising: (a) computationally clustering the biomolecular sequences according to a progressive homology range, to thereby generate a plurality of clusters each being of a predetermined homology of the homology range; and (b) assigning at least one ontology to each cluster of the plurality of clusters, the at least one ontology being: (i) derived from an annotation preassociated with at least one biomolecular sequence of each cluster; and/or (ii) generated from analysis of the at least one biomolecular sequence of each cluster thereby annotating biomolecular sequences.

According to still a further aspect of the present invention there is provided a system for generating a database of annotated biomolecular sequences, the system comprising a processing unit, the processing unit executing a software application configured for: (a) clustering the biomolecular sequences according to a progressive homology range, to thereby generate a plurality of clusters each being of a predetermined homology of the homology range; and (b) assigning at least one ontology to each cluster of the plurality of clusters, the at least one ontology being: (i) derived from an annotation preassociated with at least one biomolecular sequence of each cluster; and/or (ii) generated from analysis of the at least one biomolecular sequence of each cluster, to thereby annotate the biomolecular sequences; and (c) storing sequence annotations and sequence information of the annotated biomolecular sequences, thereby generating the database of annotated biomolecular sequences.

According to still a further aspect of the present invention there is provided a computer readable storage medium comprising a database stored in a retrievable manner, the database including sequence information as set forth in files:
"Transcripts_nucleotide_seqs_part1"
"Transcripts_nucleotide_seqs_part2"
"Transcripts_nucleotide_seqs_part3.new" and/or
"Protein.seqs"
provided in CD-ROMs 1 and/or 2 enclosed herewith, and sequence ontological annotations in #GO_P, #GO_F, #GO_C annotation categories in file "Summary_table.new" of CD-ROM3 enclosed herewith.

According to still further features in the described preferred embodiments the biomolecular sequences are selected from the group consisting of polynucleotide sequences and polypeptide sequences.

According to still further features in the described preferred embodiments the homology range is between 99%-35%.

According to still further features in the described preferred embodiments the analysis of the at least one biomolecular sequence includes literature text mining.

According to still further features in the described preferred embodiments the analysis of the at least one biomolecular sequence includes cellular localization prediction.

According to still further features in the described preferred embodiments the analysis of the at least one biomolecular sequence includes homology analysis.

According to still further features in the described preferred embodiments the at least one ontology is selected from the group consisting of molecular biology, microbiology, developmental biology, immunology, virology, biochemistry, physiology, pharmacology, medicine, bioinformatics, cell biology, endocrinology, structural biology, mathematics, chemistry, medicine, plant sciences, neurology, genetics, zoology, ecology, genomics, cheminformatics, computer sciences, statistics, physics and artificial intelligence.

According to still further features in the described preferred embodiments the ontology includes a subontology.

According to still further features in the described preferred embodiments the method further comprising scoring the at least one ontology assigned to a cluster of the plurality of clusters according to: (i) a degree of homology characterizing the cluster; and (ii) relevance of annotation to information obtained from literature text mining.

According to still further features in the described preferred embodiments the system further comprising scoring the at least one ontology assigned to a cluster of the plurality of clusters according to: (i) a degree of homology characterizing the cluster; and (ii) relevance of annotation to information obtained from literature text mining.

According to still further features in the described preferred embodiments the method further comprising generating a sequence profile to each cluster of the plurality of clusters following step (b).

According to still further features in the described preferred embodiments the system further comprising generating a sequence profile to each cluster of the plurality of clusters following step (b).

According to still a further aspect of the present invention there is provided a computer readable storage medium, comprising a database stored in a retrievable manner, the database including biomolecular sequence information as set forth in files:
"Transcripts_nucleotide_seqs_part1"
"Transcripts_nucleotide_seqs_part2"
"Transcripts_nucleotide_seqs_part3.new" and/or
"Protein.seqs"
provided in CD-ROMs 1 and/or 2 enclosed herewith, and biomolecular sequence annotations as set forth in file "Summary_table.new" of CD-ROM 3 enclosed herewith.

According to still a further aspect of the present invention there is provided a method of diagnosing colon cancer in a subject, the method comprising identifying in the subject the presence or absence of a biomolecular sequence selected from the group consisting of SEQ ID NOs: 4, 39, 24-28, 35-38, 12 and 29-31 wherein presence of the biomolecular sequence indicates colon cancer in the subject.

According to still a further aspect of the present invention there is provided method of diagnosing lung cancer in a subject, the method comprising identifying in the subject the presence or absence of a biomolecular sequence selected from the group consisting of SEQ ID NOs: 15, 18, 21 and 32 wherein presence of the biomolecular sequence indicates lung cancer in the subject.

According to still a further aspect of the present invention there is provided a method of diagnosing Ewing sarcoma in a subject, the method comprising identifying in the subject the presence or absence of a biomolecular sequence as set forth in SEQ ID NO: 7, wherein presence of the biomolecular sequence indicates Ewing sarcoma in the subject.

According to still a further aspect of the present invention there is provided a computer readable storage medium comprising data stored in a retrievable manner, the data including sequence information of differentially expressed biomolecular sequences as set forth in files:
"Transcripts_nucleotide_seqs_part1"
"Transcripts_nucleotide_seqs_part2"
"Transcripts_nucleotide_seqs_part3.new" and
"Protein.seqs"
provided in CD-ROMs 1 and/or 2 enclosed herewith, and sequence annotations as set forth in annotation categories "SA" and "RA", in the file "Summary_table.new" of CD-ROM3 enclosed herewith.

According to still a further aspect of the present invention there is provided a computer readable storage medium comprising data stored in a retrievable manner, the data including sequence information of biomolecular sequences exhibiting gain of function or loss of function as set forth in files:

"Transcripts_nucleotide_seqs_part1"
"Transcripts_nucleotide_seqs_part2"
"Transcripts_nucleotide_seqs_part3.new" and
"Protein.seqs"

provided in CD-ROMs 1 and/or 2 enclosed herewith, and sequence annotations as set forth in annotation category "DN", in the file "Summary_table.new" of CD-ROM3 enclosed herewith.

According to still further features in the described preferred embodiments the database further includes information pertaining to generation of the data and potential uses of the data.

According to still further features in the described preferred embodiments the medium is selected from the group consisting of a magnetic storage medium, an optical storage medium and an optico-magnetic storage medium.

According to still further features in the described preferred embodiments the database further includes information pertaining to gain and/or loss of function of the differentially expressed mRNA splice variants or polypeptides encoded thereby.

The present invention successfully addresses the shortcomings of the presently known configurations by providing methods and systems useful for systematically annotating biomolecular sequences.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting.

BRIEF DESCRIPTION OF THE DRAWINGS

The invention is herein described, by way of example only, with reference to the accompanying drawings. With specific reference now to the drawings in detail, it is stressed that the particulars shown are by way of example and for purposes of illustrative discussion of the preferred embodiments of the present invention only, and are presented in the cause of providing what is believed to be the most useful and readily understood description of the principles and conceptual aspects of the invention. In this regard, no attempt is made to show structural details of the invention in more detail than is necessary for a fundamental understanding of the invention, the description taken with the drawings making apparent to those skilled in the art how the several forms of the invention may be embodied in practice.

In the drawings:

FIG. 1b illustrates a remote configuration of the system described in FIG. 1a.

FIG. 4 is a tissue hierarchy dendogram generated according to the teachings of the present invention. The higher annotation levels are marked with a single number, i.e., 1-16. The lower annotation levels are marked within the relevant category as one-four numbers after the point (e.g. 4. genitourinary system; 4.2 genital system; 4.2.1 women genital system; 4.2.1.1 cervix).

DESCRIPTION OF THE PREFERRED EMBODIMENTS

Figure 1A:
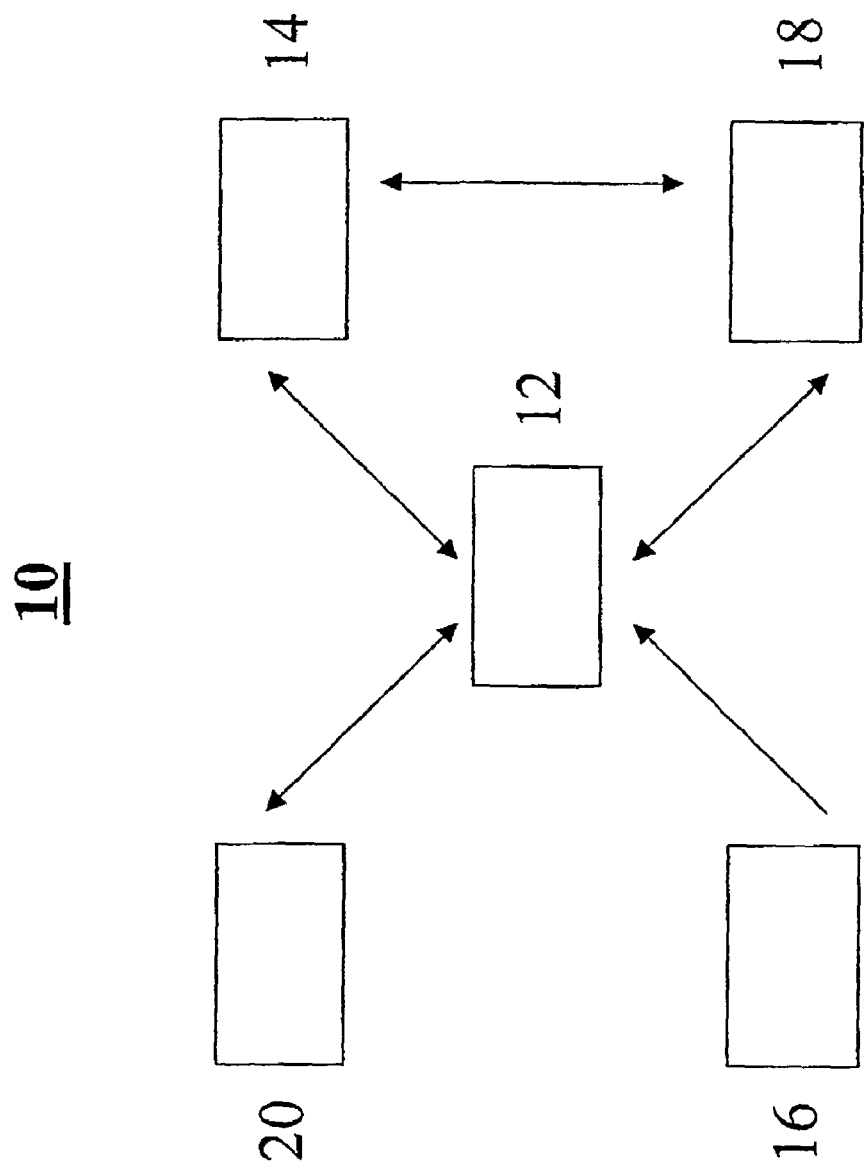
FIG. 1a illustrates a system designed and configured for generating a database of annotated biomolecular sequences according to the teachings of the present invention.

The present invention is of methods and systems, which can be used for annotating biomolecular sequences. Specifically, the present invention can be used to identify and annotate differentially expressed biomolecular sequences, such as differentially expressed alternatively spliced sequences.

The principles and operation of the present invention may be better understood with reference to the drawings and accompanying descriptions.

Before explaining at least one embodiment of the invention in detail, it is to be understood that the invention is not limited in its application to the details of construction and the arrangement of the components set forth in the following description or illustrated in the drawings. The invention is capable of other embodiments or of being practiced or carried out in various ways. Also, it is to be understood that the phraseology and terminology employed herein is for the purpose of description and should not be regarded as limiting.

Terminology

As used herein, the term "oligonucleotide" refers to a single stranded or double stranded oligomer or polymer of ribonucleic acid (RNA) or deoxyribonucleic acid (DNA) or mimetics thereof. This term includes oligonucleotides composed of naturally-occurring bases, sugars and covalent internucleoside linkages (e.g., backbone) as well as oligonucleotides having non-naturally-occurring portions which function similarly. Such modified or substituted oligonucleotides are often preferred over native forms because of desirable properties such as, for example, enhanced cellular uptake, enhanced affinity for nucleic acid target and increased stability in the presence of nucleases.

The phrase "complementary DNA" (cDNA) refers to the double stranded or single stranded DNA molecule, which is synthesized from a messenger RNA template.

The term "contig" refers to a series of overlapping sequences with sufficient identity to create a longer contiguous sequence. A plurality of contigs may form a cluster. Clusters are generally formed based upon a specified degree of homology and overlap (e.g., a stringency). The different contigs in a cluster do not typically represent the entire sequence of the gene, rather the gene may comprise one or more unknown intervening sequences between the defined contigs.

The term "cluster" refers to a nucleic acid sequence cluster or a protein sequence cluster. The former refers to a group of nucleic acid sequences which share a requisite level of homology and or other similar traits according to a given clustering criterion; and the latter refers to a group of protein sequences which share a requisite level of homology and/or other similar traits according to a given clustering criterion.

A process and/or method to group nucleic acid or protein sequences as such is referred to as clustering, which is typically performed by a clustering (i.e., alignment) application program implementing a cluster algorithm.

As used herein the phrase "biomolecular sequences" refers to amino acid sequences (i.e., peptides, polypeptides) and nucleic acid sequences, which include but are not limited to genomic sequences, expressed sequence tags, contigs, complementary DNA (cDNA) sequences, pre-messenger RNA (mRNA) sequences, and mRNA sequences.

With the presentation of the human genome working draft, data analysis rather than data collection presents the biggest challenge to biologists. Efforts to ascribe biological meaning to genomic data, include the development of advanced wet laboratorial techniques as well as computerized algorithms. While the former are limited due to inaccuracy, time consumption, labor intensiveness and costs the latter are still unfeasible due to the poor organization of on hand sequence databases as well as the composite nature of biological data.

As is further described hereinbelow, the present inventors have developed a computer-based approach for the functional, spatial and temporal analysis of biological data. The present methodology generates comprehensive databases which greatly facilitate the use of available genetic information in both research and commercial applications.

As is further described hereinunder, the present invention encompasses several novel approaches for annotating biomolecular sequences.

"Annotating" refers to the act of discovering and/or assigning an annotation (i.e., critical or explanatory notes or comment) to a biomolecular sequence of the present invention.

The term "annotation" refers to a functional or structural description of a sequence, which may include identifying attributes such as locus name, keywords, Medline references, cloning data, information of coding region, regulatory regions, catalytic regions, name of encoded protein, subcellular localization of the encoded protein, protein hydrophobicity, protein function, mechanism of protein function, information on metabolic pathways, regulatory pathways, protein-protein interactions and tissue expression profile.

The Ontological Annotation Approach

An ontology refers to the body of knowledge in a specific knowledge domain or discipline such as molecular biology, microbiology, immunology, virology, plant sciences, pharmaceutical chemistry, medicine, neurology, endocrinology, genetics, ecology, genomics, proteomics, cheminformatics, pharmacogenomics, bioinformatics, computer sciences, statistics, mathematics, chemistry, physics and artificial intelligence.

An ontology includes domain-specific concepts—referred to herein as sub-ontologies. A sub-ontology may be classified into smaller and narrower categories.

The ontological annotation approach of the present invention is effected as follows.

First, biomolecular sequences are computationally clustered according to a progressive homology range, thereby generating a plurality of clusters each being of a predetermined homology of the homology range.

Progressive homology according to this aspect of the present invention is used to identify meaningful homologies among biomolecular sequences and thereby assign new ontological annotations to sequences, which share requisite levels of homologies. Essentially, a biomolecular sequence is assigned to a specific cluster if displays a predetermined homology to at least one member of the cluster (i.e., single linkage). As used herein "progressive homology range" refers to a range of homology thresholds, which progress via predetermined increments from a low homology level (e.g. 35%) to a high homology level (e.g. 99%). Further description of a progressive homology range is provided in the Examples section which follows.

Following generation of clusters, one or more ontologies are assigned to each cluster. Ontologies are derived from an annotation preassociated with at least one biomolecular sequence of each cluster; and/or generated by analyzing (e.g., text-mining) at least one biomolecular sequence of each cluster thereby annotating biomolecular sequences.

Any annotational information identified and/or generated according to the teachings of the present invention can be stored in a database which can be generated by a suitable computing platform.

Thus, the method according to this aspect of the present invention provides a novel approach for annotating biomolecular sequences even on a scale of a genome, a transcriptom (i.e., the repertoire of all messenger RNA molecules transcribed from a genome) or a proteom (i.e., the repertoire of all proteins translated from messenger RNA molecules). This enables transcriptome-wise comparative analyses (e.g., analyzing chromosomal distribution of human genes) and cross-transcriptome comparative studies (e.g., comparing expressed data across species) both of which may involve various subontologies such as molecular function, biological process and cellular localization.

Biomolecular sequences which can be used as working material for the annotating process according to this aspect of the present invention can be obtained from a biomolecular sequence database. Such a database can include protein sequences and/or nucleic acid sequences derived from libraries of expressed messenger RNA [i.e., expressed sequence tags (EST)], cDNA clones, contigs, pre-mRNA, which are prepared from specific tissues or cell-lines or from whole organisms.

This database can be a pre-existing publicly available database [i.e., GenBank database maintained by the National Center for Biotechnology Information (NCBI), part of the National Library of Medicine, and the TIGR database maintained by The Institute for Genomic Research, Blocks database maintained by the Fred Hutchinson Cancer Research Center, Swiss-Prot site maintained by the University of Geneva and GenPept maintained by NCBI and including public protein-sequence database which contains all the protein databases from GenBank,] or private databases (i.e., the LifeSeq.™ and PathoSeq.™ databases available from Incyte Pharmaceuticals, Inc. of Palo Alto, Calif.). Optionally, biomolecular sequences of the present invention can be assembled from a number of pre-existing databases as described in Example 5 of the Examples section.

Alternatively, the database can be generated from sequence libraries including, but not limited to, cDNA libraries, EST libraries, mRNA libraries and the like.

Construction and sequencing of a cDNA library is one approach for generating a database of expressed mRNA sequences. cDNA library construction is typically effected by tissue or cell sample preparation, RNA isolation, cDNA sequence construction and sequencing.

It will be appreciated that such cDNA libraries can be constructed from RNA isolated from whole organisms, tissues, tissue sections, or cell populations. Libraries can also be constructed from a tissue reflecting a particular pathological or physiological state.

Once raw sequence data is obtained, biomolecular sequences are computationally clustered according to a progressive homology range using one or more clustering algorithms. To obtain progressive clusters, the biomolecular sequences are clustered through single linkage. Namely, a biomolecular sequence belongs to a cluster if this sequence shares a sequence homology above a certain threshold to one member of the cluster. The threshold increments from a high homology level to a low homology level with a predetermined resolution. Preferably the homology range is selected from 99% -35%.

Computational clustering can be effected using any commercially available alignment software including the local homology algorithm of Smith & Waterman, Adv. Appl. Math. 2:482 (1981), using the homology alignment algorithm of Needleman & Wunsch, J. Mol. Biol. 48:443 (1970), using the search for similarity method of Pearson & Lipman, Proc. Nat'l. Acad. Sci. USA 85:2444 (1988), or using computerized implementations of algorithms GAP, BESTFIT, FASTA, and TFASTA in the Wisconsin Genetics Software Package Release 7.0, Genetics Computer Group, 575 Science Dr., Madison, Wis.

Another example of an algorithm which is suitable for sequence alignment is the BLAST algorithm, which is described in Altschul et al., J. Mol. Biol. 215:403-410 (1990). Software for performing BLAST analyses is publicly available through the website of the National Center for Biotechnology Information.

Since the present invention requires processing of large amounts of data, sequence alignment is preferably effected using assembly software.

A number of commonly used computer software fragment read assemblers capable of forming clusters of expressed sequences, and aligning members of the cluster (individually or as an assembled contig) with other sequences (e.g., genomic database) are now available. These packages include but are not limited to, The TIGR Assembler [Sutton G. et al. (1995) Genome Science and Technology 1:9-19], GAP [Bonfield J K. et al. (1995) Nucleic Acids Res. 23:4992-4999], CAP2 [Huang X. et al. (1996) Genomics 33:21-31], the Genome Construction Manager [Laurence C B. Et al. (1994) Genomics 23:192-201], Bio Image Sequence Assembly Manager, SeqMan [Swindell S R. and Plasterer J N. (1997) Methods Mol. Biol. 70:75-89], and LEADS and GenCarta (Compugen Ltd. Israel).

It will be appreciated that since applying sequence homology analysis on large number of sequences is computationally intensive, local alignment (i.e., the alignment of portions of protein sequences) is preferably effected prior to global alignment (alignment of protein sequences along their entire length), as described in Example 6 of the Examples section.

Once progressive clusters are formed, one or more ontological annotations (i.e., assigning an ontology) are assigned to each cluster.

Systematic and standardized ontological nomenclature is preferably used. Such nomenclature (i.e., keywords) can be obtained from several sources. For example, ontological annotations derived from three main ontologies: molecular function, biological process and cellular component are available from the website of the Gene Ontology Consortium.

Alternatively a list of homogenized ontological nomenclature can be obtained from the website of Acromed—a computer generated database of biomedical acronyms and the associated long forms extracted from the recent Medline abstracts (available at the website of the Expert Protein Analysis System-ExPASy, Swiss Institute for Bioinformatics).

Optionally, various conversion tables which link Enzyme Commission number, InterPro protein motifs and SwissProt keywords to gene ontology nodes are also available from the Gene Ontology Consortium website (see above) and can be used with the present method.

Ontologies, sub ontologies, and their ontological relations (i.e., inherent relation—the sub-ontology "IS THE" ontology or composite relation—the ontology "HAS" the sub ontology) can be organized into various computer data structures such as a tree, a map, a graph, a stack or a list. These may also be presented in various data format such as, text, table, html, or extensible markup language (XML)

Ontologies and/or subontologies assigned to a specific biomolecular sequence can be derived from an annotation, which is preassociated with at least one biomolecular sequence in a cluster generated as described hereinabove.

For example, biomolecular sequences obtained from an annotated database are typically preassociated with an annotation. An "annotated database" refers to a database biomolecular sequences, which are at least partially characterized with respect to functional or structural aspects of the sequence. Examples of annotated databases include but are not limited to: GenBank (available at the website of NCBI, Natl Library of Medicine of the Natl Institutes of Health), Swiss-Prot (available at the Expert Protein Analysis System ExPASy website of the Swiss Institute of Bioinformatics), GDB (www dot gdb dot org), PIR (available at www dot mips dot Biochem dot mpg dot de), YDB (available at www dot mips dot Biochem dot mpg dot de), MIPS (available at www dot mips dot Biochem dot mpg dot de), HGI (available at www dot tigr dot org), Celera Assembled Human Genome (available at the website of Celera www dot Celera dot com) and LifeSeq Gold (available at the website of Incyte Pharmaceuticals, Palo Alto, Calif.). Additional specialized annotated databases include annotative information on metabolic (available at www dot genome dot ad dot ip, search kegg/metabolism) and regulatory pathways (available at www dot genome dot ad dot jp search kegg/regulation), and protein-protein interactions (available at the website of University of California at Los Angeles website under dip.doe-mbi), etc.

Alternatively, ontologies can be generated from an analysis of at least one biomolecular sequence in each of the clusters of the present invention.

Preferably, analysis of the biomolecular sequence is effected by literature text mining. Since manual review of related-literature may be a daunting task, computational extraction of text information is preferably effected.

Thus, the method of the present invention can also process literature and other textual information and utilize processed textual data for generating additional ontological annotations. For example, text information contained in the sequence-related publications and definition lines in sequence records of sequence databases can be extracted and processed. Ontological annotations derived from processed text data are then assigned to the sequences in the corresponding clusters.

Ontological annotations can also be extracted from sequence associated Medical subject heading (MeSH) terms which are assigned to published papers.

Additional information on text mining is provided in Example 7 of the Examples section and is disclosed in "Mining Text Using Keyword Distributions," Ronen Feldman, Ido Dagan, and Haym Hirsh, Proceedings of the 1995 Workshop on Knowledge Discovery in Databases, "Finding Associations in Collections of Text," Ronen Feldman and Haym Hirsh, Machine Learning and Data Mining: Methods and Applications, edited by R. S. Michalski, I. Bratko, and M. Kubat, John Wiley & Sons, Ltd., 1997 "Technology Text Mining, Turning Information Into Knowledge: A White Paper from IBM," edited by Daniel Tkach, Feb. 17, 1998, each of which is fully incorporated herein by reference.

It will be appreciated that text mining may be performed, in this and other embodiments of the present invention, for the text terms extracted from the definitions of gene or protein sequence records, retrievable from databases such as GenBank and Swiss-Prot and title line, abstract of scientific papers, retrievable from Medline database (e.g., PubMed at the NCBI website).

Computer-dedicated software for biological text analysis is available from Expert Protein Analysis System ExPASy website of the Swiss Institute of Bioinformatics. Examples include, but are not limited to, MedMiner—A software system which extracts and organizes relevant sentences in the literature based on a gene, gene-gene or gene-drug query; Protein Annotator's Assistant —A software system which assists protein annotators in the task of assigning functions to newly sequenced proteins; and XplorMed—A software system which explores a set of abstracts derived from a bibliographic search in MEDLINE.

Alternatively, assignment of ontological annotations may be effected by analyzing molecular, cellular and/or functional traits of the biomolecular sequences. Prediction of cellular localization may be done using any computer dedicated software. For example prediction of cellular localization can be done using the ProLoc (Einat Hazkani-Covo, Erez Levanon, Galit Rotman, Dan Graur and Amit Novik, a manuscript submitted for publication) computational platform. This software is capable of predicting the cellular localization of polypeptide sequences based on inherent features, including specific localization signatures, protein domains, amino acid composition, pI and protein length. Other examples for cellular localization prediction softwares include PSORT—Prediction of protein sorting signals and localization sites and TargetP—Prediction of subcellular location, both available from the from Expert Protein Analysis System ExPASy website of the Swiss Institute of Bioinformatics.

Prediction of functional annotations may be effected by motif analysis of the biomolecular sequences of the present invention. Thus for example, by implementing any motif analysis software, which is based on protein homology (see for example, genome.net at the Kyoto University Bioinformatics Center website) it is possible to predict functional motifs of DNA sequences including repeats, promoter sequences and CpG islands and of encoded proteins such as zinc finger and leucine zipper.

Due to the progressive nature of the clusters of the present invention, ontology assignment starts at the highest level of homology. Any biomolecular sequence in the cluster, which shares identical level of homology compared to an ontologically annotated protein in the cluster is assigned the same ontological annotation. This procedure progresses from the highest level of homology to a lower threshold level with a predetermined increment resolution. Newly discovered homologies enable assignment of existing ontological annotations to biomolecular sequences sharing homologous sequences and being previously unannotated or partially annotated (see Examples 5-9 of the Examples section).

Once assignment of an annotation is effected, annotated clusters are disassembled resulting in annotation of each biomolecular sequence of the cluster.

Such annotated biomolecular sequences are then tested for false annotation. This is effected using the following scoring parameters:

(i) A degree of homology characterizing the progressive cluster—accuracy of the annotation directly correlates with the homology level used for the annotation process (see Examples 7-9 of the Examples section).

(ii) Relevance of annotation to information obtained from literature text mining—each assigned ontological annotation which results from literature text mining or functional or cellular prediction is assessed using scoring parameters such as LOD score (For further details see Example 7 of the Examples section).

The present invention also enables the use of the homologies identified according to the teachings of the present invention to annotate more sensitively and rapidly a query sequence. Essentially this involves building a sequence profile for each annotated cluster. A profile enables scoring of a biomolecular sequence according to functional domains along a sequence and generally makes searches more sensitive. Essentially, clustered sequences are also tested for relevance to the cluster based upon shared functional domains and other characteristic sequence features.

Ontologically annotated biomolecular sequences are stored in a database for further use. Additional information on generation and contents of such databases is provided hereinunder.

Such a database can be used to query functional domains and sequences comprising thereof. Alternatively, the database can be used to query a sequence, and retrieve the compatible annotations.

Although the present methodology can be effected using prior art systems modified for such purposes, due to the large amounts of data processed and the vast amounts of processing needed, the present methodology is preferably effected using a dedicated computational system.

Figure 1B:
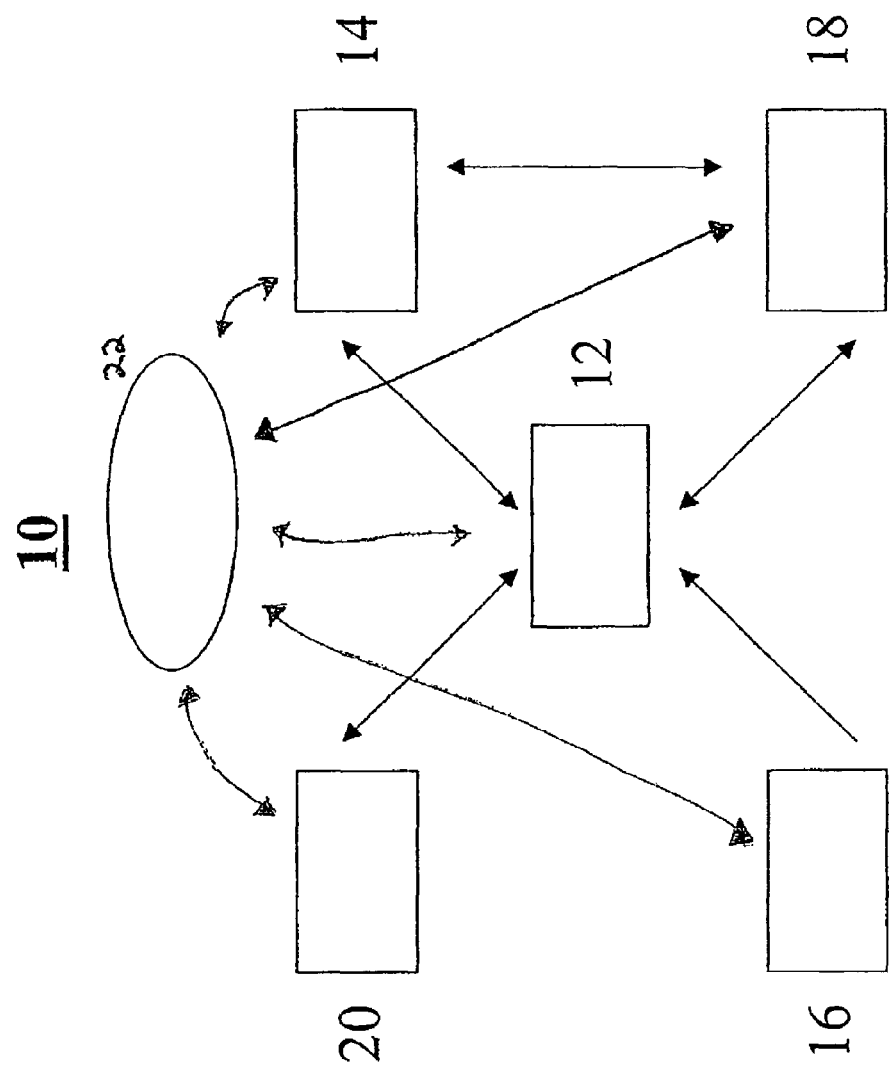

Thus, according to another aspect of the present invention and as illustrated in FIGS. 1a-b, there is provided a system for generating a database of annotated biomolecular sequences.

System 10 includes a processing unit 12, which executes a software application designed and configured for annotating biomolecular sequences, as described hereinabove. System 10 further serves for storing biomolecular sequence information and annotations in a retrievable/searchable database 18. Database 18 further includes information pertaining to database generation.

System 10 may also include a user interface 14 (e.g., a keyboard and/or a mouse, monitor) for inputting database or database related information, and for providing database information to a user.

System 10 of the present invention may be any computing platform known in the art including but not limited to a personal computer, a work station, a mainframe and the like.

Preferably, database 18 is stored on a computer readable media such as a magnetic optico-magnetic or optical disk.

System 10 of the present invention may be used by a user to query the stored database of annotations and sequence information to retrieve biomolecular sequences stored therein according to inputted annotations or to retrieve annotations according to a biomolecular sequence query.

It will be appreciated that the connection between user interface 14 and processing unit 12 is bi-directional. Likewise, processing unit 12 and database 18 also share a two-way communication channel, wherein processing unit 12 may also take input from database 18 in performing annotations and iterative annotations. Further, user interface 14 is linked directly to database 18, such a user may dispatch queries to database 18 and retrieve information stored therein. As such, user interface 14 allows a user to compile queries, send instructions, view querying results and performing specific analyses on the results as needed.

In performing ontological annotations, processing unit 12 may take input from one or more application modules 16. Application module 16 performs a specific operation and produced a relevant annotative input for processing unit 12. For example, application module 16 may perform cellular localization analysis on a biomolecular sequence query, thereby determining the cellular localization of the encoded protein. Such a functional annotation is then input to and used by processing unit 12. Examples for application software for cellular localization prediction are provided hereinabove.

System 10 of the present invention may also be connected to one or more external databases 20. External database 20 is linked to processing unit 12 in a bi-directional manner, similar to the connection between database 18 and processing unit 12. External database 20 may include any background information and/or sequence information that pertains to the biomolecular sequence query. External database 20 may be a proprietary database or a publicly available database which is accessible through a public network such as the Internet. External database 20 may feed relevant information to processing unit 12 as it effects iterative ontological annotation. External database 20 may also receive and store ontological annotations generated by processing unit 12. In this case external database 20 may interact with other components of system 10 like database 18.

It will be appreciated that the databases and application modules of system 10 can be directly connected with processing unit 12 and/or user interface 14 as is illustrated in FIG. 1*a*, or such a connection can be achieved via a network 22, as is illustrated in FIG. 1*b*.

Network 22 may be a private network (e.g., a local area network), a secured network, or a public network (such as the Internet), or a combination of public and private and/or secured networks.

Thus, the present invention provides a well characterized approach for the systemic annotation of biomolecular sequences. The use of text information analysis, annotation scoring system and robust sequence clustering procedure enables for the first time the creation of the best possible annotations and assignment thereof to a vast number of biomolecular sequences sharing homologous sequences. The availability of ontological annotations for a significant number of biomolecular sequences from different species can provide a comprehensive account of sequence, structural and functional information pertaining to the biomolecular sequences of interest.

The Hierarchical Annotation Approach

"Hierarchical annotation" refers to any ontology and sub-ontology, which can be hierarchically ordered. Examples include but are not limited to a tissue expression hierarchy, a developmental expression hierarchy, a pathological expression hierarchy, a cellular expression hierarchy, an intracellular expression hierarchy, a taxonomical hierarchy, a functional hierarchy and so forth.

According to another aspect of the present invention there is provided a method of annotating biomolecular sequences according to a hierarchy of interest. The method is effected as follows.

First, a dendrogram representing the hierarchy of interest is computationally constructed. As used herein a "dendrogram" refers to a branching diagram containing multiple nodes and representing a hierarchy of categories based on degree of similarity or number of shared characteristics.

Each of the multiple nodes of the dendrogram is annotated by at least one keyword describing the node, and enabling literature and database text mining, as is further described hereinunder. A list of keywords can be obtained from the website of the Gene Ontology Consortium; measures are taken to include as many keywords, and to include keywords which might be out of date. For example, for tissue annotation (see FIG. 4), a hierarchy was built using all available tissue/libraries sources available in the GenBank, while considering the following parameters: ignoring GenBank synonyms, building anatomical hierarchies, enabling flexible distinction between tissue types (normal versus pathology) and tissue classification levels (organs, systems, cell types, etc.).

Figure 2:
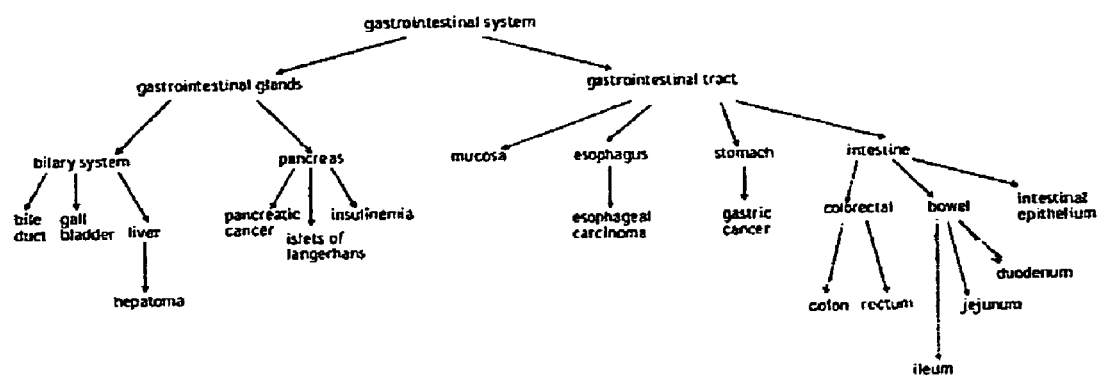
FIG. 2 illustrates a gastrointestinal tissue hierarchy dendogram generated according to the teachings of the present invention.

It will be appreciated that the dendrogram of the present invention can be illustrated as a graph, a list, a map or a matrix or any other graphic or textual organization, which can describe a dendrogram. An example of a dendrogram illustrating the gastrointestinal tissue hierarchy is provided in FIG. 2.

In a second step, each of the biomolecular sequences is assigned to at least one specific node of the dendrogram.

The biomolecular sequences according to this aspect of the present invention can be annotated biomolecular sequences, unannotated biomolecular sequences or partially annotated biomolecular sequences.

Annotated biomolecular sequences can be retrieved from pre-existing annotated databases as described hereinabove.

For example, in GenBank, relevant annotational information is provided in the definition and keyword fields. In this case, classification of the annotated biomolecular sequences to the dendrogram nodes is directly effected. A search for suitable annotated biomolecular sequences is performed using a set of keywords which are designed to classify the biomolecular sequences to the hierarchy (i.e., same keywords that populate the dendrogram)

In cases where the biomolecular sequences are unannotated or partially annotated, extraction of additional annotational information is effected prior to classification to dendrogram nodes. This can be effected by sequence alignment, as described hereinabove. Alternatively, annotational information can be predicted from structural studies. Where needed, nucleic acid sequences can be transformed to amino acid sequences to thereby enable more accurate annotational prediction.

Finally, each of the assigned biomolecular sequences is recursively classified to nodes hierarchically higher than the specific nodes, such that the root node of the dendrogram encompasses the full biomolecular sequence set, which can be classified according to a certain hierarchy, while the offspring of any node represent a partitioning of the parent set.

For example, a biomolecular sequence found to be specifically expressed in "rhabdomyosarcoma", will be classified also to a higher hierarchy level, which is "sarcoma", and then to "Mesenchimal cell tumors" and finally to a highest hierarchy level "Tumor". In another example, a sequence found to be differentially expressed in endometrium cells, will be classified also to a higher hierarchy level, which is "uterus", and then to "women genital system" and to "genital system" and finally to a highest hierarchy level "genitourinary system". The retrieval can be performed according to each one of the requested levels.

Since annotation of publicly available databases is at times unreliable, newly annotated biomolecular sequences are confirmed using computational or laboratory approaches as is further described hereinbelow.

It will be appreciated that once temporal or spatial annotations of sequences are established using the teachings of the present invention, it is possible to identify those sequences, which are differentially expressed (i.e., exhibit spatial or temporal pattern of expression in diverse cells or tissues). Such sequences are assigned to only a portion of the nodes, which constitute the hierarchical dendrogram.

Changes in gene expression are important determinants of normal cellular physiology, including cell cycle regulation, differentiation and development, and they directly contribute to abnormal cellular physiology, including developmental anomalies, aberrant programs of differentiation and cancer. Accordingly, the identification, cloning and characterization of differentially expressed genes can provide relevant and important insights into the molecular determinants of processes such as growth, development, aging, differentiation and cancer. Additionally, identification of such genes can be useful in development of new drugs and diagnostic methods for treating or preventing the occurrence of such diseases.

Newly annotated sequences identified according to the present invention are tested under physiological conditions (i.e., temperature, pH, ionic strength, viscosity, and like biochemical parameters which are compatible with a viable organism, and/or which typically exist intracellularly in a viable cultured yeast cell or mammalian cell). This can be effected using various laboratory approaches such as, for example, FISH analysis, PCR, RT-PCR, southern blotting, northern blotting, electrophoresis and the like (see Examples 13-20 of the Examples section) or more elaborate approaches which are detailed in the Background section.

It will be appreciated that true involvement of differentially expressed genes in a biological process is better confirmed using an appropriate cell or animal model, as further described hereinunder.

Although the present methodology can be effected using prior art systems modified for such purposes, due to the large amounts of data processed and the vast amounts of processing needed, the present methodology is preferably effected using a dedicated computational system.

Such a system is described hereinabove. The system includes a processing unit which executes a software application designed and configured for hierarchically annotating biomolecular sequences as described hereinabove. The system further serves for storing biomolecular sequence information and annotations in a retrievable/searchable database.

The hierarchical annotation approach enables to assign an appropriate annotation level even in cases where expression is not restricted to a specific tissue type or cell type. For example, different expressed sequences of a single contig which are annotated as being expressed in several different tissue types of a single specific organ or a specific system, are also annotated by the present invention to a higher hierarchy level thus denoting association with the specific organ or system. In such cases using keywords alone would not efficiently identify differentially expressed sequences. Thus for example, a sequence found to be expressed in sarcoma, Ewing sarcoma tumors, pnet, rhabdomyosarcoma, liposarcoma and mesenchymal cell tumors, can not be assigned to specific sarcomas, but still can be annotated as mesenchymal cell tumor specific. Using this hierarchical annotation approach in combination with advanced sequence clustering and assembly algorithms, capable of predicting alternative splicing, may facilitate a simple and rapid identification of gene expression patterns.

Annotation of Differentially Expressed Alternatively Spliced Sequences

Although numerous methods have been developed to identify differentially expressed genes, none of these addressed splice variants, which occur in over 50% of human genes. Given the common sequence features of splice variants it is very difficult to identify splice variants which expression is differential, using prior art methodologies. Therefore assigning unique sequence features to differentially expressed splice variants may have an important impact to the understanding of disease development and may serve as valuable markers to various pathologies.

Thus, according to another aspect of the present invention there is provided a method of identifying sequence features unique to differentially expressed mRNA splice variants. The method is effected as follows.

First, unique sequence features are computationally identified in identified splice variants of alternatively spliced expressed sequences.

As used herein the phrase "splice variants" refers to naturally occurring nucleic acid sequences and proteins encoded therefrom which are products of alternative splicing. Alternative splicing refers to intron inclusion, exon exclusion, or any addition or deletion of terminal sequences, which results in sequence dissimilarities between the splice variant sequence and the wild-type sequence.

Although most alternatively spliced variants result from alternative exon usage, some result from the retention of introns not spliced-out in the intermediate stage of RNA transcript processing.

As used herein the phrase "unique sequence features" refers to donor/acceptor concatenations (i.e., exon-exon junctions), intron sequences, alternative exon sequences and alternative polyadenylation sequences.

Once a unique sequence feature is identified, the expression pattern of the splice variant is determined. If the splice variant is differentially expressed then the unique feature thereof is annotated accordingly.

Alternatively spliced expressed sequences of this aspect of the present invention, can be retrieved from numerous publicly available databases. Examples include but are not limited to ASDB—an alternative splicing database generated using GenBank and Swiss-Prot annotation, AsMamDB—a database of alternative splices in human, mouse and rat, Alternative splicing database a database—a database of alternative splices from literature, Yeast intron database—Database of intron in yeast, available at the University of California at Santa Cruz website, The Intronerator—alternative splicing in *C. elegans* based on analysis of EST data available at the University of California at Santa Cruz website, ISIS—Intron Sequence Information System including a section of human alternative splices, available at the University of Queensland, Australia, website, and TAP—Transcript Assembly Program result of alternative splicing available at the website of Washington University at St. Louis and HASDB—database of alternative splices detected in human EST data.

Additionally, alternative splicing sequence data utilized by this aspect of the present invention can be obtained by any of the following bioinformatical approaches.

(i) Genomically aligned ESTs—the method identifies ESTs which come from the same gene and looks for differences between them that are consistent with alternative splicing, such as large insertion or deletion in one EST. Each candidate splice variant can be further assessed by aligning the ESTs with respective genomic sequence. This reveals candidate exons (i.e., matches to the genomic sequence) separated by candidate splices (i.e., large gaps in the EST-genomic alignment). Since intronic sequences at splice junctions (i.e., donor/acceptor concatenations) are highly conserved (essentially 99.24% of introns have a GT-AG at their 5' and 3' ends, respectively) sequence data can be used to verify candidate splices [Burset et al. (2000) Nucleic Acids Res. 28:4364-75 LEADS module [Shoshan, et al, Proceeding of SPIE (eds. M. L. Bittner, Y. Chen, A. N. Dorsel, E. D. Dougherty) Vol. 4266, pp. 86-95 (2001).; R. Sorek, G. Ast, D. Graur, Genome Res. In press; Compugen Ltd. U.S. patent application Ser. No. 09/133,987].

(ii) Identification based on intron information—The method creates a database of individual intron sequences annotated in GenBank and utilizes such sequences to search for EST sequences which include the intronic sequences [Croft et al. (2000) Nat. Genet. 24:340-1].

(iii) EST alignment to expressed sequences—looks for insertions and deletions in ESTs relative to a set of known mRNAs. Such a method enables to uncover alternatively spliced variants with having to align ESTs with genomic sequence [Brett et al. (2000) FEBS Lett. 474-83-86].

It will be appreciated that in order to avoid false positive identification of novel splice isoforms, a set of filters is applied. For example, sequences are filtered to exclude EST having sequence deviations, such as chimerism, random variation in which a given EST sequence or potential vector contamination at the ends of an EST.

Filtering can be effected by aligning ESTs with corresponding genomic sequences. Chimeric ESTs can be easily excluded by requiring that each EST aligns completely to a single genomic locus. Genomic location found by homology search and alignment can often be checked against radiation hybrid mapping data [Muneer et al (2002) Genomic 79:344-8]. Furthermore, since the genomic regions which align with an EST sequence correspond to exon sequences and alignment gaps correspond to introns, the putative splice sites at exon/intron boundaries can be confirmed. Because splice donor and acceptor sites primarily reside within the intron sequence, this methodology can provide validation which is independent of the EST evidence. Reverse transcriptase artifacts or other cDNA synthesis errors may also be filtered out using this approach. Improper inclusion of genomic sequence in ESTs can also be excluded by requiring pairs of mutually exclusive splices in different ESTs.

Additionally, it will be appreciated that observing a given splice variant in one EST but not in a second EST may be insufficient, as the latter can be an un-spliced EST rather than a biological significant intron inclusion. Therefore measures are taken to focus on mutually exclusive splice variants, two different splice variants observed in different ESTs, which overlap in a genomic sequence. A more stringent filtering may be applied by requiring two splice variants to share one splice site but differ in another.

Once splice variants are identified, identification of unique sequence features therewithin can be effected computationally by identifying insertions, deletions and donor-acceptor concatenations in ESTs relative to mRNA and preferably genomic sequences.

As mentioned hereinabove, once alternatively spliced sequences (having unique sequence features) are identified, determination of their expression patterns is effected in order to assign an annotation to the unique sequence feature thereof.

Expression pattern identification may be effected by qualifying annotations which are preassociated with the alternatively spliced expressed sequences, as described hereinabove. This can be accomplished by scoring the annotations. For example scoring pathological expression annotations can be effected according to: (i) prevalence of the alternatively spliced expressed sequences in normal tissues; (ii) prevalence of the alternatively spliced expressed sequences in pathological tissues; (iii) prevalence of the alternatively spliced expressed sequence in total tissues; and (iv) number of tissues and/or tissue types expressing the alternatively spliced expressed sequences.

Alternatively, identifying the expression pattern of the alternatively spliced expressed sequences of the present invention, is accomplished by identifying the unique sequence feature thereof. This can be effected by any hybridization-based technique known in the art, such as northern blot, dot blot, RNase protection assay, RT-PCR and the like.

To this end oligonucleotides probes, which are substantially homologous to nucleic acid sequences that flank and/or extend across the unique sequence features of the alternatively spliced expressed sequences of the present invention are generated.

Preferably, oligonucleotides which are capable of hybridizing under stringent, moderate or mild conditions, as used in any polynucleotide hybridization assay are utilized. Further description of hybridization conditions is provided hereinunder.

Oligonucleotides generated by the teachings of the present invention may be used in any modification of nucleic acid hybridization based techniques, which are further detailed hereinunder. General features of oligonucleotide synthesis and modifications are also provided hereinunder.

Aside from being useful in identifying specific splice variants, oligonucleotides generated according to the teachings of the present invention may also be widely used as diagnostic, prognostic and therapeutic agents in a variety of disorders which are associated with specific splice variants.

Regulation of splicing is involved in 15% of genetic diseases [Krawzczak et al. (1992) Hum. Genet. 90:41-54] and may contribute for example to cancer mis-splicing of exon 18 in BRCA1, which is caused by a polymorphism in an exonic enhancer [Liu et al. (2001) Nature Genet. 27:55-58].

Thus, oligonucleotides generated according to the teachings of the present invention can be included in diagnostic kits. For example, oligonucleotides sets pertaining to a specific disease associated with differential expression of an alternatively spliced transcript can be packaged in a one or more containers with appropriate buffers and preservatives along with suitable instructions for use and used for diagnosis or for directing therapeutic treatment. Additional information on such diagnostic kits is provided hereinunder.

It will be appreciated that an ability to identify alternatively spliced sequences, also facilitates identification of the various products of alternative splicing.

Recent studies indicate that most alternative splicing events result in an altered protein product [International human genome sequencing consortium (2001) Nature 409: 860-921; Modrek et al. (2001) Nucleic Acids Res. 29:2850-2859]. The majority of these changes appear to have a functional relevance (i.e., up-regulating or down-regulating activity), such as the replacement of the amino or carboxyl terminus, or in-frame addition and removal of a functional domain. For example, alternative splicing can lead to the use of a different site for translation initiation (i.e., alternative initiation), a different translation termination site due to a frameshift (i.e., truncation or extension), or the addition or removal of a stop codon in the alternative coding sequence (i.e., alternative termination). Additionally, alternative splicing can change an internal sequence region due to an in-frame insertion or deletion. One example of the latter is the new FC receptor β-like protein, whose C-terminal transmembrane domain and cytoplasmic tail, which is important for signal transduction in this class of receptors, is replaced with a new transmembrane domain and tail by alternative polyadenylation. Another example is the truncated Growth Hormone Receptor which lacks most of its intracellular domain and has been shown to heterodimerize with the full-length receptor, thus causing inhibition of signaling by Growth Hormone [Ross, R. J. M., Growth hormone & IGF Research, 9:42-46, (1999)].

Thus, assigning a unique sequence feature to a functionally altered splice variant enables identification of such variants. As used herein the phrase "functionally altered splice variants" refers to alternatively spliced expressed sequences, which protein products exhibit gain of function or loss of function or modification of the original function.

As used herein the phrase "gain of function" refers to any alternative splicing product, which exhibits increased functionality as compared to the wild type gene product.

As used herein the phrase "loss of function" refers to any alternative splicing product, which exhibits reduced function as compared to the wild type gene product including any reduction in function, total absence of function or dominant negative function.

As used herein the phrase "dominant negative" refers to the dominant effect of a splice variant on the activity of wild type mRNA. For example, a protein product of an altered splice variant may bind a wild type target protein without enzymatically activating it (e.g., receptor dimmers), thus blocking and preventing the active enzymes from binding and activating the target protein.

As used herein the phrase "functional domain" refers to a region of a polypeptide, which displays a particular function. This function may give rise to a biological, chemical, or physiological consequence which may be reversible or irreversible and which may include protein-protein interactions (e.g., binding interactions) involving the functional domain, a change in the conformation or a transformation into a different chemical state of the functional domain or of molecules acted upon by the functional domain, the transduction of an intracellular or intercellular signal, the regulation of gene or protein expression, the regulation of cell growth or death, or the activation or inhibition of an immune response.

Identification of putative functionally altered splice variants, according to this aspect of the present invention, can be effected by identifying sequence deviations from functional domains of wild-type gene products.

Identification of functional domains can be effected by comparing a wild-type gene product with a series of profiles prepared by alignment of well characterized proteins from a number of different species. This generates a consensus profile, which can then be matched with the query sequence. Examples of programs suitable for such identification include, but are not limited to, InterPro Scan—Integrated search in PROSITE, Pfam, PRINTS and other family and domain databases, available at the European Bioinformatics Institute website; ScanProsite—Scans a sequence against PROSITE or a pattern against SWISS-PROT and TrEMBL, available at the ExPASy-Swiss Institute of Bioinformatics website; MotifScan—Scans a sequence against protein profile databases (including PROSITE), available at the hits-Swiss Institute of Bioinformatics website; Frame-ProfileScan —Scans a short DNA sequence against protein profile databases (including PROSITE), available at the ISREC-Swiss Institute of Bioinformatics website; Pfam HMM search—scans a sequence against the Pfam protein families database; FingerPRINTScan—Scans a protein sequence against the PRINTS Protein Fingerprint Database, available at the website of the University of Manchester, UK; FPAT— Regular expression searches in protein databases; PRATT —Interactively generates conserved patterns from a series of unaligned proteins, available at the European Bioinformatics Institute website; PPSEARCH—Scans a sequence against PROSITE (allows a graphical output), available at the European Bioinformatics Institute website; at EBI; PROSITE scan—Scans a sequence against PROSITE (allows mismatches), available at the website of ncsa-Pole Bio-Informatique Lyonnais, France (PBIL); PATTIN-PROT—Scans a protein sequence or a protein database for one or several pattern(s), available at the website of ncsa-Pole Bio-Informatique Lyonnais, France; (PBIL);SMART — Simple Modular Architecture Research Tool, available at the website of the European Molecular Biology Laboratory (EMBL); TIERESIAS —Generate patterns from a collection of unaligned protein or DNA sequences; at IBM, all available at the ExPASy-Swiss Institute of Bioinformatics website.

It will be appreciated that functionally altered splice variants may also include a sequence alteration at a post-translation modification consensus site, such as, for example, a tyrosine sulfation site, a glycosylation site, etc. Examples of post-translational modification prediction softwares include but are not limited to: SignalP —Prediction of signal peptide cleavage sites; ChloroP—Prediction of chloroplast transit peptides; MITOPROT—Prediction of mitochondrial targeting sequences; Predotar—Prediction of mitochondrial and plastid targeting sequences; NetOGlyc—Prediction of type O-glycosylation sites in mammalian proteins; DictyOGlyc— Prediction of GlcNAc O-glycosylation sites in Dictyostelium; YinOYang—O-beta-GlcNAc attachment sites in eukaryotic protein sequences; bin-PI Predictor—GPI Modification Site Prediction; DGPI—Prediction of GPI-anchor and cleavage sites (Mirror site); NetPhos—Prediction of Seine, Threonine and Tyrosine phosphorylation sites in eukaryotic proteins; NetPicoRNA Prediction of protease cleavage sites in piconaviral proteins; NMT —Prediction of N-terminal N-myristoylation; Sulfinator—Prediction of tyrosine sulfation sites all available at the ExPASy-Swiss Institute of Bioinformatics website.

Once putative functionally altered splice variants are identified, they are validated by experimental verification and functional studies, using methodologies well known in the art.

The Examples section which follows illustrates identification and annotation of splice variants. Identified and annotated sequences are contained within the enclosed CD-ROMs 1-3. Some of these sequences represent (i.e., are transcribed from) entirely new splice variants, while others represent new splice variants of known sequences. In any case, the sequences contained in the enclosed CD-ROM are novel in that they include previously undisclosed sequence regions in the context of a known gene or an entirely new sequence in the context of an unknown gene.

The nucleic acids of the invention can be "isolated" or "purified." In the event the nucleic acid is genomic DNA, it is considered "isolated" when it does not include coding sequence(s) of a gene or genes immediately adjacent thereto in the naturally occurring genome of an organism; although some or all of the 5' or 3' non-coding sequence of an adjacent gene can be included. For example, an isolated nucleic acid (DNA or RNA) can include some or all of the 5' or 3' non-coding sequence that flanks the coding sequence (e.g., the DNA sequence that is transcribed into, or the RNA sequence that gives rise to, the promoter or an enhancer in the mRNA). For example, an isolated nucleic acid can contain less than about 5 kb (e.g., less than about 4 kb, 3 kb, 2 kb, 1 kb, 0.5 kb, or 0.1 kb) of the 5' and/or 3' sequence that naturally flanks the nucleic acid molecule in a cell in which the nucleic acid naturally occurs. In the event the nucleic acid is RNA or mRNA, it is "isolated" or "purified" from a natural source (e.g., a tissue) or a cell culture when it is substantially free of the cellular components with which it naturally associates in the cell and, if the cell was cultured, the cellular components and medium in which the cell was cultured (e.g., when the RNA or mRNA is in a form that contains less than about 20%, 10%, 5%, 1%, or less, of other cellular components or culture medium). When chemically synthesized, a nucleic acid (DNA or RNA) is "isolated" or "purified" when it is substantially free of the chemical precursors or other chemicals used in its synthesis (e.g., when the nucleic acid is in a form that contains less than about 20%, 10%, 5%, 1%, or less, of the chemical precursors or other chemicals).

Variants, fragments, and other mutant nucleic acids are also envisaged by the present invention. As noted above, where a given biomolecular sequence represents a new gene (rather than a new splice variant of a known gene), the nucleic acids of the invention include the corresponding genomic DNA and RNA. Accordingly, where a given SEQ ID represents a new gene, variations or mutations can occur not only in that nucleic acid sequence, but in the coding regions, the non-coding regions, or both, of the genomic DNA or RNA from which it was made.

The nucleic acids of the invention can be double-stranded or single-stranded and can, therefore, either be a sense strand, an antisense strand, or a portion (i.e., a fragment) of either the sense or the antisense strand. The nucleic acids of the invention can be synthesized using standard nucleotides or nucleotide analogs or derivatives (e.g., inosine, phosphorothioate, or acridine substituted nucleotides), which can alter the nucleic acid's ability to pair with complementary sequences or to resist nucleases. Indeed, the stability or solubility of a nucleic acid can be altered (e.g., improved) by modifying the nucleic acid's base moiety, sugar moiety, or phosphate backbone. For example, the nucleic acids of the invention can be modified as taught by Toulmé [Nature Biotech. 19:17, (2001)] or Faria et al. [Nature Biotech. 19:40-44, (2001)], and the deoxyribose phosphate backbone of nucleic acids can be modified to generate peptide nucleic acids [PNAs; see Hyrup et al., (1996) Bioorganic & Medicinal Chemistry 4:5-23].

PNAs are nucleic acid "mimics"; the molecule's natural backbone is replaced by a pseudopeptide backbone and only the four nucleotide bases are retained. This allows specific hybridization to DNA and RNA under conditions of low ionic strength. PNAs can be synthesized using standard solid phase peptide synthesis protocols as described, for example by Hyrup et al. (supra) and Perry-O'Keefe et al. [Proc. Natl. Acad. Sci. USA (1996) 93:14670-675]. PNAs of the nucleic acids described herein can be used in therapeutic and diagnostic applications.

Moreover, the nucleic acids of the invention include not only protein-encoding nucleic acids per se (e.g., coding sequences produced by the polymerase chain reaction (PCR) or following treatment of DNA with an endonuclease), but also, for example, recombinant DNA that is: (a) incorporated into a vector (e.g., an autonomously replicating plasmid or virus), (b) incorporated into the genomic DNA of a prokaryote or eukaryote, or (c) part of a hybrid gene that encodes an additional polypeptide sequence (i.e., a sequence that is heterologous to the nucleic acid sequences of the present invention or fragments, other mutants, or variants thereof).

This aspect of the present invention includes naturally occurring sequences of the nucleic acid sequences described above, allelic variants (same locus; functional or non-functional), homologs (different locus), and orthologs (different organism) as well as degenerate variants of those sequences and fragments thereof. The degeneracy of the genetic code is well known, and one of ordinary skill in the art will be able to make nucleotide sequences that differ from the nucleic acid sequences of the present invention but nevertheless encode the same proteins as those encoded by the nucleic acid sequences of the present invention. The variant sequences (e.g., degenerate variants) can be used in the same manner as naturally occurring sequences. For example, the variant DNA sequences of the invention can be incorporated into a vector, into the genomic DNA of a prokaryote or eukaryote, or made part of a hybrid gene. Moreover, variants (or, where appropriate, the proteins they encode) can be used in the diagnostic assays and therapeutic regimes described below.

The sequence of nucleic acids of the invention can also be varied to maximize expression in a particular expression system. For example, as few as one and as many as about 20% of the codons in a given sequence can be altered to optimize expression in bacterial cells (e.g., E. coli), yeast, human, insect, or other cell types (e.g., CHO cells).

The nucleic acids of the invention can also be shorter or longer than those disclosed on CD-ROMs 1 and 2. Where the nucleic acids of the invention encode proteins, the protein-encoding sequences can differ from those represented by specific sequences of file "Protein.seqs" in CD-ROM 2. For example, the encoded proteins can be shorter or longer than those encoded by one of the nucleic acid sequences of the present invention. Nucleotides can be deleted from, or added to, either or both ends of the nucleic acid sequences of the present invention or the novel portions of the sequences that represent new splice variants. Alternatively, the nucleic acids can encode proteins in which one or more amino acid residues have been added to, or deleted from, one or more sequence positions within the nucleic acid sequences.

The nucleic acid fragments can be short (e.g., 15-30 nucleotides). For example, in cases where peptides are to be expressed therefrom such polynucleotides need only contain a sufficient number of nucleotides to encode novel antigenic epitopes. In cases where nucleic acid fragments serve as DNA or RNA probes or PCR primers, fragments are selected of a length sufficient for specific binding to one of the sequences representing a novel gene or a unique portion of a novel splice variant.

Nucleic acids used as probes or primers are often referred to as oligonucleotides, and they can hybridize with a sense or antisense strand of DNA or RNA. Nucleic acids that hybridize to a sense strand (i.e., a nucleic acid sequence that encodes protein, e.g., the coding strand of a double-stranded cDNA molecule) or to an mRNA sequence are referred to as antisense oligonucleotides. Antisense oligonucleotides can be used to specifically inhibit transcription of any of the nucleic acid sequences of the present invention.

Design of antisense molecules must be effected while considering two aspects important to the antisense approach. The first aspect is delivery of the oligonucleotide into the cytoplasm of the appropriate cells, while the second aspect is design of an oligonucleotide which specifically binds the designated mRNA within cells in a way which inhibits translation thereof.

The prior art teaches of a number of delivery strategies which can be used to efficiently deliver oligonucleotides into a wide variety of cell types [see, for example, Luft (1998) J Mol Med 76 (2): 75-6; Kronenwett et al. (1998) Blood 91 (3): 852-62; Rajur et al. (1997) Bioconjug Chem 8 (6): 935-40; Lavigne et al. (1997) Biochem Biophys Res Commun 237 (3): 566-71 and Aoki et al. (1997) Biochem Biophys Res Commun 231 (3): 540-5].

In addition, algorithms for identifying those sequences with the highest predicted binding affinity for their target mRNA based on a thermodynamic cycle that accounts for the energetics of structural alterations in both the target mRNA and the oligonucleotide are also available [see, for example, Walton et al. (1999) Biotechnol Bioeng 65 (1): 1-9].

Such algorithms have been successfully used to implement an antisense approach in cells. For example, the algorithm developed by Walton et al. enabled scientists to successfully design antisense oligonucleotides for rabbit beta-globin (RBG) and mouse tumor necrosis factor-alpha (TNF alpha) transcripts. The same research group has more recently reported that the antisense activity of rationally selected oligonucleotides against three model target mRNAs (human lactate dehydrogenase A and B and rat gp130) in cell culture as evaluated by a kinetic PCR technique proved effective in almost all cases, including tests against three different targets in two cell types with phosphodiester and phosphorothioate oligonucleotide chemistries.

In addition, several approaches for designing and predicting efficiency of specific oligonucleotides using an in vitro system were also published (Matveeva et al. (1998) Nature Biotechnology 16, 1374-1375).

Several clinical trials have demonstrated safety, feasibility and activity of antisense oligonucleotides. For example, antisense oligonucleotides suitable for the treatment of cancer have been successfully used (Holmund et al. (1999) Curr Opin Mol Ther 1 (3):372-85), while treatment of hematological malignancies via antisense oligonucleotides targeting c-myb gene, p53 and Bcl-2 had entered clinical trials and had been shown to be tolerated by patients [Gerwitz (1999) Curr Opin Mol Ther 1 (3):297-306].

More recently, antisense-mediated suppression of human heparanase gene expression has been reported to inhibit pleural dissemination of human cancer cells in a mouse model [Uno et al. (2001) Cancer Res 61 (21):7855-60].

Thus, the current consensus is that recent developments in the field of antisense technology which, as described above, have led to the generation of highly accurate antisense design algorithms and a wide variety of oligonucleotide delivery systems, enable an ordinarily skilled artisan to design and implement antisense approaches suitable for downregulating expression of known sequences without having to resort to undue trial and error experimentation.

Antisense oligonucleotides can also be a-anomeric nucleic acids, which form specific double-stranded hybrids with complementary RNA in which, contrary to the usual b-units, the strands run parallel to each other [Gaultier et al., Nucleic Acids Res. 15:6625-6641, (1987)]. Alternatively, antisense nucleic acids can comprise a 2'-o-methylribonucleotide [Inoue et al., Nucleic Acids Res. 15:6131-6148, (1987)] or a chimeric RNA-DNA analogue [Inoue et al., FEBS Lett. 215: 327-330, (1987)].

The nucleic acid sequences described above can also include ribozymes catalytic sequences. Such a ribozyme will have specificity for a protein encoded by the novel nucleic acids described herein (by virtue of having one or more sequences that are complementary to the cDNAs that represent novel genes or the novel portions (i.e., the portions not found in related splice variants) of the sequences that represent new splice variants. These ribozymes can include a catalytic sequence encoding a protein that cleaves mRNA [see U.S. Pat. No. 5,093,246 or Haselhoff and Gerlach, Nature 334:585-591, (1988)]. For example, a derivative of a tetrahymena L-19 IVS RNA can be constructed in which the nucleotide sequence of the active site is complementary to the nucleotide sequence to be cleaved in an mRNA of the invention (e.g., one of the nucleic acid sequences of the present invention; see, U.S. Pat. Nos. 4,987,071 and 5,116,742). Alternatively, the mRNA sequences of the present invention can be used to select a catalytic RNA having a specific ribonuclease activity from a pool of RNA molecules [see, e.g., Bartel and Szostak, Science 261:1411-1418, (1993); see also Krol et al., Bio-Techniques 6:958-976, (1988)].

Fragments having as few as 9-10 nucleotides (e.g., 12-14, 15-17, 18-20, 21-23, or 24-27 nucleotides) can be useful as probes or expression templates and are within the scope of the present invention. Indeed, fragments that contain about 15-20 nucleotides can be used in Southern blotting, Northern blotting, dot or slot blotting, PCR amplification methods (where naturally occurring or mutant nucleic acids are amplified), colony hybridization methods, in situ hybridization, and the like.

The present invention also encompasses pairs of oligonucleotides (these can be used, for example, to amplify the new genes, or portions thereof, or the novel portions of the splice variant in, for example, potentially diseased tissue) and groups of oligonucleotides (e.g., groups that exhibit a certain degree of homology (e.g., nucleic acids that are 90% identical to one another) or that share one or more functional attributes).

When used, for example, as probes, the nucleic acids of the invention can be labeled with a radioactive isotope (e.g., using polynucleotide kinase to add $^{32}$P-labeled ATP to the oligonucleotide used as the probe) or an enzyme. Other labels, such as chemiluminescent, fluorescent, or calorimetric, labels can be used.

As noted above, the invention features nucleic acids that are complementary to those represented by the nucleic acid sequences of the present invention or novel portions thereof (i.e., novel fragments) and as such are capable of hybridizing therewith. In many cases, nucleic acids that are used as probes or primers are absolutely or completely complementary to all, or a portion of, the target sequence. However, this is not always necessary. The sequence of a useful probe or primer can differ from that of a target sequence so long as it hybridizes with the target under the stringency conditions described herein (or the conditions routinely used to amplify sequences by PCR) to form a stable duplex.

Hybridization of a nucleic acid probe to sequences in a library or other sample of nucleic acids is typically performed under moderate to high stringency conditions. Nucleic acid duplex or hybrid stability is expressed as the melting temperature (Tm), which is the temperature at which a probe dissociates from a target DNA and, therefore, helps define the required stringency conditions. To identify sequences that are related or substantially identical to that of a probe, it is useful to first establish the lowest temperature at which only homologous hybridization occurs with a particular concentration of salt (e.g., SSC or SSPE). (The terms "identity" or "identical" as used herein are equated with the terms "homology" or "homologous"). Then, assuming a 1% mismatch requires a 1° C. decrease in the Tm, the temperature of the wash (e.g., the final wash) following the hybridization reaction is reduced accordingly. For example, if sequences having at least 95% identity with the probe are sought, the final wash temperature is decreased by 5° C. In practice, the change in Tm can be between 0.5° C. and 1.5° C. per 1% mismatch The hybridization conditions described here can be employed when the nucleic acids of the invention are used in, for example, diagnostic assays, or when one wishes to identify, for example, the homologous genes that fall within the scope of the invention (as stated elsewhere, the invention encompasses allelic variants, homologues and orthologues of the sequences that represent new genes). Homologous genes will hybridize with the sequences that represent new genes under a stringency condition described herein.

A hybridization reaction is carried out at "high stringency" if hybridization (between the probe and a potential target sequence) is carried out at 68° C. in (a) 5×SSC/5× Denhardt's solution/1.0% SDS, (b) 0.5 M NaHPO$_4$ (pH 7.2)/1 mM EDTA/7% SDS, or (c) 50% formamide/0.25 M NaHPO$_4$ (pH 7.2)/0.25 M NaCl/1 mM EDTA/7% SDS, and washing is carried out with (a) 0.2×SSC/0.1% SDS at room temperature or at 42° C., (b) 0.1×SSC/0.1% SDS at 68° C., or (c) 40 mM NaHPO$_4$ (pH 7.2)/1 mM EDTA and either 1% or 5% SDS at 50° C.

"Moderately stringent" conditions constitute the hybridization conditions described above and one or more washes in 3×SSC at 42° C. Of course, salt concentration and temperature can be varied to achieve the optimal level of identity between the probe and the target nucleic acid. This is well known in the art, and additional guidance is available in, for example, Sambrook et al., 1989, Molecular Cloning, A Laboratory Manual, Cold Spring Harbor Laboratory Press, Cold Spring Harbor, N.Y., and Ausubel et al. (eds.), 1995, Current Protocols in Molecular Biology, John Wiley & Sons, New York, N.Y.

As mentioned hereinabove, the nucleic acid sequences of the present invention can be modified to encode substitution mutants of the wild type forms. Substitution mutants can include amino acid residues that represent either a conservative or non-conservative change (or, where more than one residue is varied, possibly both). A "conservative" substitution is one in which one amino acid residue is replaced with another having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). The invention includes polypeptides that include one, two, three, five, or more conservative amino acid substitutions, where the resulting mutant polypeptide has at least one biological activity that is the same, or substantially the same, as a biological activity of the wild type polypeptide.

Fragments or other mutant nucleic acids can be made by mutagenesis techniques well known in the art, including those applied to polynucleotides, cells, or organisms (e.g., mutations can be introduced randomly along all or part of the nucleic acid sequences of the present invention by saturation mutagenesis). The resultant mutant proteins can be screened for biological activity to identify those that retain activity or exhibit altered activity.

In certain embodiments, nucleic acids of the invention differ from the nucleic acid sequences provided in files "Transcripts_nucleotide_seqs_part1", "Transcripts_nucleotide_seqs_part2", "Transcripts_nucleotide_seqs_part3.new" and "ProDG_seqs" (provided in CD-ROM1 and CD-ROM2) by at least one, but less than 10, 20, 30, 40, 50, 100, or 200 nucleotides or, alternatively, at less than 1%, 5%, 10% or 20% of the nucleotides in the subject nucleic acid (excluding, of course, splice variants known in the art). Similarly, in certain embodiments, proteins of the invention can differ from those encoded by those included in File "Protein.seqs" (provided in CD-ROM2) by at least one, but less than 10, 20, 30, 40, 50, 100, or 200 amino acid residues or, alternatively, at less than 1%, 5%, 10% or 20% of the amino acid residues in a subject protein (excluding, of course, proteins encoded by splice variants known in the art (proteins of the invention are described in more detail below)). If necessary for this analysis (or any other test for homology or substantial identity described herein), the sequences should be aligned for maximum homology, as described elsewhere here.

The present invention also encompasses mutants [e.g., nucleic acids that are 80% (or more) identical to one of the nucleic acid sequences disclosed in CD-ROMs 1 and 2], which encode proteins that retain substantially at least one, or preferably substantially all of the biological activities of the referenced protein. What constitutes "substantially all" may vary considerably. For example, in some instances, a variant or mutant protein may be about 5% as effective as the protein from which it was derived. But if that level of activity is sufficient to achieve a biologically significant result (e.g., transport of a sufficient number of ions across a cell membrane), the variant or mutant protein is one that retains substantially all of at least one of the biological activities of the protein from which it was derived. A "biologically active" variant or mutant (e.g., fragment) of a protein can participate in an intra- or inter-molecular interaction that can be characterized by specific binding between molecules two or more identical molecules (in which case, homodimerization could occur) or two or more different molecules (in which case, heterodimerization could occur). Often, a biologically active fragment will be recognizable by virtue of a recognizable domain or motif, and one can confirm biological activity experimentally. More specifically, for example, one can make (by synthesis or recombinant techniques) a nucleic acid fragment that encodes a potentially biologically active portion of a protein of the present invention by inserting the active fragment into an expression vector, and expressing the protein (genetic constructs and expression systems are described further below), and finally assessing the ability of the protein to function.

The present invention also encompasses chimeric nucleic acid sequences that encode fusion proteins. For example, a nucleic acid sequence of the invention can include a sequence that encodes a hexa-histidine tag (to facilitate purification of bacterially-expressed proteins) or a hemagglutinin tag (to facilitate purification of proteins expressed in eukaryotic cells).

The fused heterologous sequence can also encode a portion of an immunoglobulin (e.g., the constant region (Fc) of an IgG molecule), a detectable marker, or a signal sequence (e.g., a sequence that is recognized and is cleaved by a signal peptidase in the host cell in which the fusion protein is expressed). Fusion proteins containing an Fc region can be purified using a protein A column, and they have increased stability (e.g., a greater circulating half-life) in vivo.

Detectable markers are well known in the art and can be used in the context of the present invention. For example, the expression vector pUR278 (Ruther et al., EMBO J., 2:1791, 1983) can be used to fuse a nucleic acid of the invention to the lacZ gene (which encodes β-galactosidase).

A nucleic acid sequence of the invention can also be fused to a sequence that, when expressed, improves the quantity or quality (e.g., solubility) of the fusion protein. For example, pGEX vectors can be used to express the proteins of the invention fused to glutathione S-transferase (GST). In general, such fusion proteins are soluble and can be easily purified from lysed cells by adsorption to glutathione-agarose beads followed by elution in the presence of free glutathione. The pGEX vectors (Pharmacia Biotech Inc; Smith and Johnson, Gene 67:31-40, 1988) are designed to include thrombin or factor Xa protease cleavage sites so that the cloned target gene product can be released from the GST moiety. Other useful vectors include pMAL (New England Biolabs, Beverly, Mass.) and pRIT5 (Pharmacia, Piscataway, N.J.), which fuse maltose E binding protein and protein A, respectively, to a protein of the invention.

A signal sequence, when present, can facilitate secretion of the fusion protein from a cell, and can be cleaved off by the host cell. The nucleic acid sequences of the present invention can also be fused to "inactivating" sequences, which render the fusion protein encoded, as a whole, inactive. Such proteins can be referred to as "preproteins," and they can be converted into an active form of the protein by removal of the inactivating sequence.

The present invention also encompasses genetic constructs (e.g., plasmids, cosmids, and other vectors that transport nucleic acids) that include a nucleic acid of the invention in a sense or antisense orientation. The nucleic acids can be operably linked to a regulatory sequence (e.g., a promoter, enhancer, or other expression control sequence, such as a polyadenylation signal) that facilitates expression of the nucleic acid. The vector can replicate autonomously or integrate into a host genome, and can be a viral vector, such as a replication defective retrovirus, an adenovirus, or an adeno-associated virus.

When present, the regulatory sequence can direct constitutive or tissue-specific expression of the nucleic acid. Tissue-specific promoters include, for example, the liver-specific albumin promoter (Pinkert et al., Genes Dev. 1:268-277, 1987), lymphoid-specific promoters (Calame and Eaton, Adv. Immunol. 43:235-275, 1988), such as those of T cell receptors (Winoto and Baltimore, EMBO J. 8:729-733, 1989) and immunoglobulins (Banerji et al., Cell 33:729-740, 1982; Queen and Baltimore, Cell 33:741-748, 1983), the neuron-specific neurofilament promoter (Byrne and Ruddle, Proc. Natl. Acad. Sci. USA 86:5473-5477, 1989), pancreas-specific promoters (Edlund et al., Science 230:912-916, 1985), and mammary gland-specific promoters (e.g., milk whey promoter; see U.S. Pat. No. 4,873,316 and European Application Publication No. 264,166). Developmentally-regulated promoters can also be used. Examples of such promoters include the murine hox promoters (Kessel and Gruss, Science 249: 374-379, 1990) and the fetoprotein promoter (Campes and Tilghman, Genes Dev. 3:537-546, 1989). Moreover, the promoter can be an inducible promoter. For example, the promoter can be regulated by a steroid hormone, a polypeptide hormone, or some other polypeptide (e.g., that used in the tetracycline-inducible system, "Tet-On" and "Tet-Off"; see, e.g., Clontech Inc. (Palo Alto, Calif.), Gossen and Bujard Proc. Natl. Acad. Sci. USA 89:5547, 1992, and Paillard, Human Gene Therapy 9:983, 1989).

The expression vector will be selected or designed depending on, for example, the type of host cell to be transformed and the level of protein expression desired. For example, when the host cells are mammalian cells, the expression vector can include viral regulatory elements, such as promoters derived from polyoma, Adenovirus 2, cytomegalovirus and Simian Virus 40. The nucleic acid inserted (i.e., the sequence to be expressed) can also be modified to encode residues that are preferentially utilized in E. coli (Wada et al., Nucleic Acids Res. 20:2111-2118, 1992). These modifications can be achieved by standard DNA synthesis techniques.

Expression vectors can be used to produce the proteins encoded by the nucleic acid sequences of the invention ex vivo (e.g., the expressed proteins can be purified from expression systems such as those described herein) or in vivo (in, for example, whole organisms). Proteins can be expressed in vivo in a way that restores expression to within normal limits and/or restores the temporal or spatial patterns of expression normally observed. Alternatively, proteins can be aberrantly expressed in vivo (i.e., at a time or place, or to an extent, that does not normally occur in vivo). For example, proteins can be over expressed or under expressed with respect to expression in a wild-type state; expressed at a different developmental stage; expressed at a different time during the cell cycle; or expressed in a tissue or cell type where expression does not normally occur.

The present invention also encompasses various engineered cells, including cells that have been engineered to express or over-express a nucleic acid sequence described herein. Accordingly, the cells can be transformed with a genetic construct, such as those described above. A "transformed" cell is a cell into which (or into an ancestor of which) one has introduced a nucleic acid that encodes a protein of the invention. The nucleic acid can be introduced by any of the art-recognized techniques for introducing nucleic acids into a host cell (e.g., calcium phosphate or calcium chloride co-precipitation, DEAE-dextran-mediated transfection, lipofection, or electroporation).

The terms "transformed cell" or "host cell" refer not only to the particular subject cell, but also to the progeny or potential progeny of such cells. Mutations or environmental influences may modify the cells in succeeding generations and, even though such progeny may not be identical to the parent cell, they are nevertheless within the scope of the invention. The cells of the invention can be "isolated" cells or "purified preparations" of cells (e.g., an in vitro preparation of cells), either of which can be obtained from multicellular organisms such as plants and animals (in which case the purified preparation would constitute a subset of the cells from the organism). In the case of unicellular microorganisms (e.g., microbial cells), the preparation is purified when at least 10% (e.g., 25%, 50%, 75%, 80%, 90%, 95% or more) of the cells within it are the cells of interest (e.g., the cells that express a protein of the invention).

The expression vectors of the invention can be designed to express proteins in prokaryotic or eukaryotic cells. For example, polypeptides of the invention can be expressed in bacterial cells (e.g., *E. coli*), fungi, yeast, or insect cells (e.g., using baculovirus expression vectors). For example, a baculovirus such as *Autographa californica* nuclear polyhedrosis virus (AcNPV), which grows in *Spodoptera frugiperda* cells, can be used as a vector to express foreign genes. A nucleic acid of the invention can be cloned into a non-essential region (for example the polyhedrin gene) of the viral genome and placed under control of a promoter (e.g., the polyhedrin promoter). Successful insertion of the nucleic acid results in inactivation of the polyhedrin gene and production of non-occluded recombinant virus (i.e., virus lacking the proteinaceous coat encoded by the polyhedrin gene). These recombinant viruses are then typically used to infect insect cells (e.g., *Spodoptera frugiperda* cells) in which the inserted gene is expressed (see, e.g., Smith et al., J. Virol. 46:584, 1983 and U.S. Pat. No. 4,215,051). If desired, mammalian cells can be used in lieu of insect cells, provided the virus is engineered so that the nucleic acid is placed under the control of a promoter that is active in mammalian cells.

Useful mammalian cells include rodent cells, such as Chinese hamster ovary cells (CHO) or COS cells, primate cells, such as African green monkey kidney cells, rabbit cells, or pig cells). The mammalian cells can also be human cells (e.g., a hematopoietic cell, a fibroblast, or a tumor cell). For example, HeLa cells, 293 cells, 3T3 cells, and WI38 cells are useful. Other suitable host cells are known to those skilled in the art and are discussed further in Goeddel [Gene Expression Technology: Methods in Enzymology 185, Academic Press, San Diego, Calif., (1990)].

Proteins can also be produced in plant cells, if desired. For plant cells, viral expression vectors (e.g., cauliflower mosaic virus and tobacco mosaic virus) and plasmid expression vectors (e.g., Ti plasmid) are suitable. These cells and other types are available from a wide range of sources [e.g., the American Type Culture Collection, Manassas, Va.; see also, e.g., Ausubel et al., Current Protocols in Molecular Biology, John Wiley & Sons, New York, (1994)]. The optimal methods of transformation (by, for example, transfection) and, as noted above, the choice of expression vehicle will depend on the host system selected. Transformation and transfection methods are described in, for example, Ausubel et al., supra; expression vehicles can be chosen from those provided in, for example, Pouwels et al., Cloning Vectors: A Laboratory Manual, (1985), Supp. (1987). The host cells harboring the expression vehicle can be cultured in conventional nutrient media, adapted as needed for activation of a chosen nucleic acid, repression of a chosen nucleic acid, selection of transformants, or amplification of a chosen nucleic acid.

Expression systems can be selected based on their ability to produce proteins that are modified (e.g., by phosphorylation, glycosylation, or cleavage) in substantially the same way they would be in a cell in which they are naturally expressed. Alternatively, the system can be one in which naturally occurring modifications do not occur, or occur in a different position, or to a different extent, than they otherwise would.

If desired, the host cells can be those of a stably-transfected cell line. Vectors suitable for stable transfection of mammalian cells are available to the public (see, e.g., Pouwels et al. (supra) as are methods for constructing them (see, e.g., Ausubel et al. (supra). In one example, a nucleic acid of the invention is cloned into an expression vector that includes the dihydrofolate reductase (DHFR) gene. Integration of the plasmid and, therefore, the nucleic acid it contains, into the host cell chromosome is selected for by including 0.01-300 mM methotrexate in the cell culture medium (as described in Ausubel et al., supra). This dominant selection can be accomplished in most cell types.

Moreover, recombinant protein expression can be increased by DHFR-mediated amplification of the transfected gene. Methods for selecting cell lines bearing gene amplifications are described in Ausubel et al. (supra) and generally involve extended culture in medium containing gradually increasing levels of methotrexate. DHFR-containing expression vectors commonly used for this purpose include pCVSEII-DHFR and pAdD26SV(A) (which are also described in Ausubel et al., supra).

A number of other selection systems can be used. These include those based on herpes simplex virus thymidine kinase, hypoxanthine-guanine phosphoribosyl-transferase, and adenine phosphoribosyltransferase genes, which can be employed in tk, hgprt, or aprt cells, respectively. In addition, gpt, which confers resistance to mycophenolic acid (Mulligan et al., Proc. Natl. Acad. Sci. USA, 78:2072, 1981); neo, which confers resistance to the aminoglycoside G-418 (Colberre-Garapin et al., J. Mol. Biol. 150:1, 1981); and hygro, which confers resistance to hygromycin (Santerre et al., Gene 30:147, 1981), can be used.

In view of the foregoing, it is clear that one can synthesize proteins encoded by the nucleic acid sequences of the present invention (i.e., recombinant proteins). Methods of generating and recombinant proteins are well known in the art. Recombinant protein purification can be effected by affinity. Where a protein of the invention has been fused to a heterologous protein (e.g., a maltose binding protein, a β-galactosidase protein, or a trpE protein), antibodies or other agents that specifically bind to the latter can facilitate purification. The recombinant protein can, if desired, be further purified (e.g., by high performance liquid chromatography or other standard techniques [see, Fisher, Laboratory Techniques In Biochemistry And Molecular Biology, Eds., Work and Burdon, Elsevier, (1980)].

Other purification schemes are known as well. For example, non-denatured fusion proteins can be purified from human cell lines as described by Janknecht et al. (Proc. Natl. Acad. Sci. USA, 88:8972, 1981). In this system, a nucleic acid is subcloned into a vaccinia recombination plasmid such that it is translated, in frame, with a sequence encoding an N-terminal tag consisting of six histidine residues. Extracts of cells infected with the recombinant vaccinia virus are loaded onto $Ni^{2+}$ nitriloacetic acid-agarose columns, and histidine-tagged proteins are selectively eluted with imidazole-containing buffers.

Alternatively, Chemical synthesis can also be utilized to generate the proteins of the present invention [e.g., proteins can be synthesized by the methods described in Solid Phase Peptide Synthesis, 2nd Ed., The Pierce Chemical Co., Rockford, Ill., (1984)].

The invention also features expression vectors that can be transcribed and translated in vitro using, for example, a T7 promoter and T7 polymerase. Thus, the invention encompasses methods of making the proteins described herein in vitro.

Sufficiently purified proteins can be used as described herein. For example, one can administer the protein to a patient, use it in diagnostic or screening assays, or use it to generate antibodies (these methods are described further below).

The cells per se can also be administered to patients in the context of replacement therapies. For example, a nucleic acid of the present invention can be operably linked to an inducible promoter (e.g., a steroid hormone receptor-regulated promoter) and introduced into a human or nonhuman (e.g., porcine) cell and then into a patient. Optionally, the cell can be cultivated for a time or encapsulated in a biocompatible material, such as poly-lysine alginate. See, e.g., Lanza, Nature Biotechnol. 14:1107, (1996); Joki et al. Nature Biotechnol. 19:35, 2001; and U.S. Pat. No. 5,876,742] When a steroid hormone receptor-regulated promoter is used, protein production can be regulated in the subject by administering a steroid hormone to the subject. Implanted recombinant cells can also express and secrete an antibody that specifically binds to one of the proteins encoded by the nucleic acid sequences of the present invention. The antibody can be any antibody or any antibody derivative described herein. An antibody "specifically binds" to a particular antigen when it binds to that antigen but not, to a detectable level, to other molecules in a sample (e.g., a tissue or cell culture) that naturally includes the antigen.

While the host cells described above express recombinant proteins, the invention also encompasses cells in which gene expression is disrupted (e.g., cells in which a gene has been knocked out). These cells can serve as models of disorders that are related to mutated or mis-expressed alleles and are also useful in drug screening.

Protein expression can also be regulated in cells without using the genetic constructs described above. Instead, one can modify the expression of an endogenous gene within a cell (e.g., a cell line or microorganism) by inserting a heterologous DNA regulatory element into the genome of the cell such that the element is operably linked to the endogenous gene. For example, an endogenous gene that is "transcriptionally silent," (i.e., not expressed at detectable levels) can be activated by inserting a regulatory element that promotes the expression of a normally expressed gene product in that cell. Techniques such as targeted homologous recombination can be used to insert the heterologous DNA (see, e.g., U.S. Pat. No. 5,272,071 and WO 91/06667).

The polypeptides of the present invention include the protein sequences contained in the File "Protein.seqs" of CD-ROM 2 and those encoded by the nucleic acids described herein (so long as those nucleic acids contain coding sequence and are not wholly limited to an untranslated region of a nucleic acid sequence), regardless of whether they are recombinantly produced (e.g., produced in and isolated from cultured cells), otherwise manufactured (by, for example, chemical synthesis), or isolated from a natural biological source (e.g., a cell or tissue) using standard protein purification techniques.

The terms "peptide," "polypeptide," and "protein" are used herein interchangeably to refer to a chain of amino acid residues, regardless of length or post-translational modification (e.g., glycosylation or phosphorylation). Proteins (including antibodies that specifically bind to the products of those nucleic acid sequences that encode protein or fragments thereof) and other compounds can be "isolated" or "purified." The proteins and compounds of the present invention are "isolated" or "purified" when they exist as a composition that is at least 60% (e.g., 70%, 75%, 80%, 85%, 90%, 95%, or 99% or more) by weight the protein or compound of interest. Thus, the proteins of the invention are substantially free from the cellular material (or other biological or cell culture material) with which they may have, at one time, been associated (naturally or otherwise). Purity can be measured by any appropriate standard method (e.g., column chromatography, polyacrylamide gel electrophoresis, or HPLC analysis The proteins of the invention also include those encoded by novel fragments or other mutants or variants of the protein-encoding sequences of the present invention. These proteins can retain substantially all (e.g., 70%, 80%, 90%, 95%, or 99%) of the biological activity of the full-length protein from which they were derived and can, therefore, be used as agonists or mimetics of the proteins from which they were derived. The manner in which biological activity can be determined is described generally herein, and specific assays (e.g., assays of enzymatic activity or ligand-binding ability) are known to those of ordinary skill in the art. In some instances, retention of biological activity is not necessary or desirable. For example, fragments that retain little, if any, of the biological activity of a full-length protein can be used as immunogens, which, in turn, can be used as therapeutic agents (e.g., to generate an immune response in a patient), diagnostic agents (e.g., to detect the presence of antibodies or other proteins in a tissue sample obtained from a patient), or to generate or test antibodies that specifically bind the proteins of the invention.

In other instances, the proteins encoded by nucleic acids of the invention can be modified (e.g., fragmented or otherwise mutated) so their activities oppose those of the naturally occurring protein (i.e., the invention encompasses variants of the proteins encoded by nucleic acids of the invention that are antagonistic to a biological process). One of ordinary skill in the art will recognize that the more extensive the mutation, the more likely it is to affect the biological activity of the protein (this is not to say that minor modifications cannot do so as well). Thus, it is likely that mutant proteins that are agonists of those encoded by wild type proteins will differ from those wild type proteins only at non-essential residues or will contain only conservative substitutions. Conversely, antagonists are likely to differ at an essential residue or to contain non-conservative substitutions. Moreover, those of ordinary skill in the art can engineer proteins so that they retain desirable traits (i.e., those that make them efficacious in a particular therapeutic, diagnostic, or screening regime) and lose undesirable traits (i.e., those that produce side effects, or produce false-positive results through non-specific binding).

In the event a protein of the invention is encoded by a new gene, the invention encompasses proteins that arise following alternative transcription, RNA splicing, translational- or post-translational events (e.g., the invention encompasses splice variants of the new genes). In the event a protein of the invention is encoded by a novel splice variant, the invention encompasses proteins that arise following alternative translational- or post-translational events (i.e., the invention does not encompass proteins encoded by known splice variants, but does encompass other variants of the novel splice variant). Post-translational modifications are discussed above in the context of expression systems.

The fragmented or otherwise mutant proteins of the invention can differ from those encoded by the nucleic acids of the invention to a limited extent (e.g., by at least one but less than 5, 10 or 15 amino acid residues). As with other, more extensive mutations, the differences can be introduced by adding, deleting, and/or substituting one or more amino acid residues. Alternatively, the mutant proteins can differ from the wild type proteins from which they were derived by at least one residue but less than 5%, 10%, 15% or 20% of the residues when analyzed as described herein. If the mutant and wild type proteins are different lengths, they can be aligned and analyzed using the algorithms described above.

Useful variants, fragments, and other mutants of the proteins encoded by the nucleic acids of the invention can be identified by screening combinatorial libraries of these variants, fragments, and other mutants for agonist or antagonist activity. For example, libraries of fragments (e.g., N-terminal, C-terminal, or internal fragments) of one or more of the proteins of the invention can be used to generate populations of fragments that can be screened and, once identified, isolated. The proteins can include those in which one or more cysteine residues are added or deleted, or in which a glycosylated residue is added or deleted. Methods for screening libraries (e.g., combinatorial libraries of proteins made from point mutants or cDNA libraries) for proteins or genes having a particular property are known in the art. These methods can be adapted for rapid screening. Recursive ensemble mutagenesis (REM), a new technique that enhances the frequency of functional mutants in libraries, can be used in combination with screening assays to identify useful variants of the proteins of the present invention [Arkin and Yourvan, Proc. Natl. Acad. Sci. USA 89:7811-7815, (1992); Delgrave et al., Protein Engineering 6:327-331, (1993)].

Cell-based assays can be exploited to analyze variegated libraries constructed from one or more of the proteins of the invention. For example, cells in a cell line (e.g., a cell line that ordinarily responds to the protein(s) of interest in a substrate-dependent manner) can be transfected with a library of expression vectors. The transfected cells are then contacted with the protein and the effect of the expression of the mutant on signaling by the protein (substrate) can be detected (e.g., by measuring redox activity or protein folding). Plasmid DNA can then be recovered from the cells that score for inhibition, or alternatively, potentiation of signaling by the protein (substrate). Individual clones are then further characterized.

The invention also contemplates antibodies (i.e., immunoglobulin molecules) that specifically bind (see the definition above) to the proteins described herein and antibody fragments (e.g., antigen-binding fragments or other immunologically active portions of the antibody). Antibodies are proteins, and those of the invention can have at least one or two heavy chain variable regions (VH), and at least one or two light chain variable regions (VL). The VH and VL regions can be further subdivided into regions of hypervariability, termed "complementarity determining regions" (CDR), which are interspersed with more highly conserved "framework regions" (FR). These regions have been precisely defined [see, Kabat et al., Sequences of Proteins of Immunological Interest, Fifth Edition, U.S. Department of Health and Human Services, NIH Publication No. 91-3242, (1991) and Chothia.et al., J. Mol. Biol. 196:901-917, (1987)], and antibodies or antibody fragments containing one or more of them are within the scope of the invention.

The antibodies of the invention can also include a heavy and/or light chain constant region [constant regions typically mediate binding between the antibody and host tissues or factors, including effector cells of the immune system and the first component (C1q) of the classical complement system], and can therefore form heavy and light immunoglobulin chains, respectively. For example, the antibody can be a tetramer (two heavy and two light immunoglobulin chains, which can be connected by, for example, disulfide bonds). The heavy chain constant region contains three domains (CH1, CH2 and CH3), whereas the light chain constant region has one (CL).

An antigen-binding fragment of the invention can be: (i) a Fab fragment (i.e., a monovalent fragment consisting of the VL, VH, CL and CH1 domains); (ii) a F(ab')$_2$ fragment (i.e., a bivalent fragment containing two Fab fragments linked by a disulfide bond at the hinge region); (iii) a Fd fragment consisting of the VH and CH1 domains; (iv) a Fv fragment consisting of the VL and VH domains of a single arm of an antibody, (v) a dAb fragment [Ward et al., Nature 341:544-546, (1989)], which consists of a VH domain; and (vi) an isolated complementarity determining region (CDR).

F(ab')$_2$ fragments can be produced by pepsin digestion of the antibody molecule, and Fab fragments can be generated by reducing the disulfide bridges of F(ab')$_2$ fragments. Alternatively, Fab expression libraries can be constructed [Huse et al., Science 246:1275, (1989)] to allow rapid and easy identification of monoclonal Fab fragments with the desired specificity. Methods of making other antibodies and antibody fragments are known in the art. For example, although the two domains of the Fv fragment, VL and VH, are coded for by separate genes, they can be joined, using recombinant methods or a synthetic linker that enables them to be made as a single protein chain in which the VL and VH regions pair to form monovalent molecules [known as single chain Fv (scFv); see e.g., Bird et al., Science 242:423-426, (1988); Huston et al., Proc. Natl. Acad. Sci. USA 85:5879-5883, (1988); Colcher et al., Ann. NY Acad. Sci. 880:263-80, (1999); and Reiter, Clin. Cancer Res. 2:245-52, (1996)]. Techniques for producing single chain antibodies are also described in U.S. Pat. Nos. 4,946,778 and 4,704,692. Such single chain antibodies are encompassed within the term "antigen-binding fragment" of an antibody. These antibody fragments are obtained using conventional techniques known to those of ordinary skill in the art, and the fragments are screened for utility in the same manner that intact antibodies are screened. Moreover, a single chain antibody can form dimers or multimers and, thereby, become a multivalent antibody having specificities for different epitopes of the same target protein.

The antibody can be a polyclonal (i.e., part of a heterogeneous population of antibody molecules derived from the sera of the immunized animals) or a monoclonal antibody (i.e., part of a homogeneous population of antibodies to a particular antigen), either of which can be recombinantly produced (e.g., produced by phage display or by combinatorial methods, as described in, e.g., U.S. Pat. No. 5,223,409; WO 92/18619; WO 91/17271; WO 92/20791; WO 92/15679; WO 93/01288; WO 92/01047; WO 92/09690; WO 90/02809; Fuchs et al., Bio/Technology 9:1370-1372, (1991); Hay et al. Human Antibody Hybridomas 3:81-85, (1992); Huse et al. Science 246:1275-1281, (1989); Griffths et al. EMBO J. 12:725-734, (1993); Hawkins et al., J. Mol. Biol 226:889-896, (1992); Clackson et al. Nature 352:624-628, (1991); Gram et al., Proc. Natl. Acad. Sci. USA 89:3576-3580, (1992); Garrad et al., Bio/Technology 9:1373-1377, (1991); Hoogenboom et al. Nucl. Acids Res. 19:4133-4137, (1991); and Barbas et al., Proc. Natl. Acad. Sci. USA 88:7978-7982, (1991). In one embodiment, an antibody is made by immunizing an animal with a protein encoded by a nucleic acid of the invention (one, of course, that contains coding sequence) or a mutant or fragment (e.g., an antigenic peptide fragment) thereof. Alternatively, an animal can be immunized with a tissue sample (e.g., a crude tissue preparation, a whole cell (living, lysed, or fractionated) or a membrane fraction). Thus, antibodies of the invention can specifically bind to a purified antigen or a tissue (e.g., a tissue section, a whole cell (living, lysed, or fractionated) or a membrane fraction).

In the event an antigenic peptide is used, it can include at least eight (e.g., 10, 15, 20, or 30) consecutive amino acid residues found in a protein of the invention. The antibodies generated can specifically bind to one of the proteins in their native form (thus, antibodies with linear or conformational epitopes are within the invention), in a denatured or otherwise non-native form, or both. Conformational epitopes can sometimes be identified by identifying antibodies that bind to a protein in its native form, but not in a denatured form.

The host animal (e.g., a rabbit, mouse, guinea pig, or rat) can be immunized with the antigen, optionally linked to a carrier (i.e., a substance that stabilizes or otherwise improves the immunogenicity of an associated molecule), and optionally administered with an adjuvant (see, e.g., Ausubel et al., supra). An exemplary carrier is keyhole limpet hemocyanin (KLH) and exemplary adjuvants, which will be selected in view of the host animal's species, include Freund's adjuvant (complete or incomplete), adjuvant mineral gels (e.g., aluminum hydroxide), surface active substances such as lysolecithin, pluronic polyols, polyanions, peptides, oil emulsions, dinitrophenol, BCG (bacille Calmette-Guerin), and *Corynebacterium parvum*. KLH is also sometimes referred to as an adjuvant. The antibodies generated in the host can be purified by, for example, affinity chromatography methods in which the polypeptide antigen is immobilized on a resin.

Epitopes encompassed by an antigenic peptide may be located on the surface of the protein (e.g., in hydrophilic regions), or in regions that are highly antigenic (such regions can be selected, initially, by virtue of containing many charged residues). An Emini surface probability analysis of human protein sequences can be used to indicate the regions that have a particularly high probability of being localized to the surface of the protein.

The antibody can be a fully human antibody (e.g., an antibody made in a mouse that has been genetically engineered to produce an antibody from a human immunoglobulin sequence, such as that of a human immunoglobulin gene (the kappa, lambda, alpha (IgA1 and IgA2), gamma (IgG1, IgG2, IgG3, IgG4), delta, epsilon and mu constant region genes or the myriad immunoglobulin variable region genes). Alternatively, the antibody can be a non-human antibody (e.g., a rodent (e.g., a mouse or rat), goat, or non-human primate (e.g., monkey) antibody).

Methods of producing antibodies are well known in the art. For example, as noted above, human monoclonal antibodies can be generated in transgenic mice carrying the human immunoglobulin genes rather than those of the mouse. Splenocytes obtained from these mice (after immunization with an antigen of interest) can be used to produce hybridomas that secrete human mAbs with specific affinities for epitopes from a human protein (see, e.g., WO 91/00906, WO 91/10741; WO 92/03918; WO 92/03917; Lonberg et al., Nature 368:856-859, 1994; Green et al., Nature Genet. 7:13-21, 1994; Morrison et al. Proc. Natl. Acad. Sci. USA 81:6851-6855, 1994; Bruggeman et al., Immunol. 7:33-40, 1993; Tuaillon et al., Proc. Natl. Acad. Sci. USA 90:3720-3724, 1993; and Bruggeman et al., Eur. J. Immunol 21:1323-1326, 1991).

The antibody can also be one in which the variable region, or a portion thereof (e.g., a CDR), is generated in a non-human organism (e.g., a rat or mouse). Thus, the invention encompasses chimeric, CDR-grafted, and humanized antibodies and antibodies that are generated in a non-human organism and then modified (in, e.g., the variable framework or constant region) to decrease antigenicity in a human. Chimeric antibodies (i.e., antibodies in which different portions are derived from different animal species (e.g., the variable region of a murine mAb and the constant region of a human immunoglobulin) can be produced by recombinant techniques known in the art. For example, a gene encoding the Fc constant region of a murine (or other species) monoclonal antibody molecule can be digested with restriction enzymes to remove the region encoding the murine Fc, and the equivalent portion of a gene encoding a human Fc constant region can be substituted therefore [see European Patent Application Nos. 125,023; 184,187; 171,496; and 173,494; see also WO 86/01533; U.S. Pat. No. 4,816,567; Better et al., Science 240:1041-1043, (1988); Liu et al., Proc. Natl. Acad. Sci. USA 84:3439-3443, (1987); Liu et al., J. Immunol. 139:3521-3526, (1987); Sun et al., Proc. Natl. Acad. Sci. USA 84:214-218, (1987); Nishimura et al., Cancer Res. 47:999-1005, (1987); Wood et al., Nature 314:446-449, (1985); Shaw et al., J. Natl. Cancer Inst. 80:1553-1559, (1988); Morrison et al., Proc. Natl. Acad. Sci. USA 81:6851, (1984); Neuberger et al., Nature 312:604, (1984); and Takeda et al., Nature 314:452, (1984)].

In a humanized or CDR-grafted antibody, at least one or two, but generally all three of the recipient CDRs (of heavy and or light immuoglobulin chains) will be replaced with a donor CDR. One need only replace the number of CDRs required for binding of the humanized antibody to a protein described herein or a fragment thereof. The donor can be a rodent antibody, and the recipient can be a human framework or a human consensus framework. Typically, the immunoglobulin providing the CDRs is called the "donor" (and is often that of a rodent) and the immunoglobulin providing the framework is called the "acceptor." The acceptor framework can be a naturally occurring (e.g., a human) framework, a consensus framework or sequence, or a sequence that is at least 85% (e.g., 90%, 95%, 99%) identical thereto. A "consensus sequence" is one formed from the most frequently occurring amino acids (or nucleotides) in a family of related sequences (see, e.g., Winnaker, From Genes to Clones, Verlagsgesellschaft, Weinheim, Germany, 1987). Each position in the consensus sequence is occupied by the amino acid residue that occurs most frequently at that position in the family (where two occur equally frequently, either can be included). A "consensus framework" refers to the framework region in the consensus immunoglobulin sequence.

An antibody can be humanized by methods known in the art. For example, humanized antibodies can be generated by replacing sequences of the Fv variable region that are not directly involved in antigen binding with equivalent sequences from human Fv variable regions. General methods for generating humanized antibodies are provided by Morrison [Science 229:1202-1207, (1985)], Oi et al. [BioTechniques 4:214, (1986)], and Queen et al. (U.S. Pat. Nos. 5,585,089; 5,693,761 and 5,693,762). Those nucleic acid sequences required by these methods can be obtained from a hybridoma producing an antibody the polypeptides of the present invention, or fragments thereof. The recombinant DNA encoding the humanized antibody, or fragment thereof, can then be cloned into an appropriate expression vector.

Humanized or CDR-grafted antibodies can be produced such that one, two, or all CDRs of an immunoglobulin chain can be replaced [see, e.g., U.S. Pat. No. 5,225,539; Jones et al., Nature 321:552-525, (1986); Verhoeyan et al., Science 239:1534, (1988); and Beidler et al., J. Immunol. 141:4053-4060, (1988)]. Thus, the invention features humanized antibodies in which specific amino acid residues have been substituted, deleted or added (in, e.g., in the framework region to improve antigen binding). For example, a humanized antibody will have framework residues identical to those of the donor or to amino acid residues other than those of the recipient framework residue. To generate such antibodies, a selected, small number of acceptor framework residues of the humanized immunoglobulin chain are replaced by the corresponding donor amino acids. The substitutions can occur adjacent to the CDR or in regions that interact with a CDR (U.S. Pat. No. 5,585,089, see especially columns 12-16). Other techniques for humanizing antibodies are described in EP 519596 A1.

In certain embodiments, the antibody has an effector function and can fix complement, while in others it can neither recruit effector cells nor fix complement. The antibody can also have little or no ability to bind an Fc receptor. For example, it can be an isotype or subtype, or a fragment or other mutant that cannot bind to an Fc receptor (e.g., the antibody can have a mutant (e.g., a deleted) Fc receptor binding region). The antibody may or may not alter (e.g., increase or decrease) the activity of a protein to which it binds.

In other embodiments, the antibody can be coupled to a heterologous substance, such as a toxin (e.g., ricin, diphtheria toxin, or active fragments thereof), another type of therapeutic agent (e.g., an antibiotic), or a detectable label. A detectable label can include an enzyme (e.g., horseradish peroxidase, alkaline phosphatase, β-galactosidase, or acetylcholinesterase), a prosthetic group (e.g., streptavidin/biotin and avidin/biotin), or a fluorescent, luminescent, bioluminescent, or radioactive material. (e.g., umbelliferone, fluorescein, fluorescein isothiocyanate, rhodamine, dichlorotriazinylamine fluorescein, dansyl chloride or phycoerythrin (which are fluorescent), luminol (which is luminescent), luciferase, luciferin, and aequorin (which are bioluminescent), and $^{125}$I, $^{131}$I, $^{35}$S or $^{3}$H (which are radioactive)).

The antibodies of the invention (e.g., a monoclonal antibody) can be used to isolate the proteins of the invention (by, for example, affinity chromatography or immunoprecipitation) or to detect them in, for example, a cell lysate or supernatant (by Western blotting, ELISAs, radioimmune assays, and the like) or a histological section. One can therefore determine the abundance and pattern of expression of a particular protein. This information can be useful in making a diagnosis or in evaluating the efficacy of a clinical test.

The invention also includes the nucleic acids that encode the antibodies described above and vectors and cells (e.g., mammalian cells such as CHO cells or lymphatic cells) that contain them. Similarly, the invention includes cell lines (e.g., hybridomas) that make the antibodies of the invention and methods of making those cell lines.

Non-human transgenic animals are also within the scope of the invention. These animals can be used to study the function or activity of proteins of the invention and to identify or evaluate agents that modulate their activity. A "transgenic animal" can be a mammal (e.g., a mouse, rat, dog, pig, cow, sheep, goat, or non-human primate), an avian (e.g., a chicken), or an amphibian (e.g. a frog) having one or more cells that include a transgene (e.g., an exogenous DNA molecule or a rearrangement (e.g., deletion of) endogenous chromosomal DNA). The transgene can be integrated into or can occur within the genome of the cells of the animal, and it can direct the expression of an encoded gene product in one or more types of cells or tissues. Alternatively, a transgene can "knock out" or reduce gene expression. This can occur when an endogenous gene has been altered by homologous recombination, which occurs between it and an exogenous DNA molecule that was introduced into a cell of the animal (e.g., an embryonic cell) at a very early stage in the animal's development.

Intronic sequences and polyadenylation signals can be included in the transgene and, when present, can increase expression. One or more tissue-specific regulatory sequences can also be operably linked to a transgene of the invention to direct expression of protein to particular cells (exemplary regulatory sequences are described above, and many others are known to those of ordinary skill in the art).

A "founder" animal is one that carries a transgene of the invention in its genome or expresses mRNA from the transgene in its cells or tissues. Founders can be bred to produce a line of transgenic animals carrying the founder's transgene or bred with founders carrying other transgenes (in which case the progeny would bear the transgenes borne by both founders). Accordingly, the invention features founder animals, their progeny, cells or populations of cells obtained therefrom, and proteins obtained therefrom. For example, a nucleic acid of the invention can be placed under the control of a promoter that directs expression of the encoded protein in the milk or eggs of the transgenic animal. The protein can then be purified or recovered from the animal's milk or eggs. Animals suitable for such purpose include pigs, cows, goats, sheep, and chickens.

The biomolecular sequences of the present invention can be divided to functional groups, according to GeneOntology classification (see the website of GeneOntology dot org), defined by the activity of the original sequences from which the new variants have been identified or to which the novel genes are homologous. Based on this classification it is possible to identify diseases and conditions which can be diagnosed and treated using novel sequence information and annotations such as those uncovered by the present invention.

Immunoglobulin:

This category contains proteins that are involved in the immune and complement systems such as antigens and autoantigens, immunoglobulins, MHC and HLA proteins and their associated proteins.

Pharmaceutical compositions including such proteins or protein encoding sequences, antibodies directed against such proteins or polynucleotides capable of altering expression of such proteins may be used to treat diseases involving the immunological system including inflammation, autoimmune diseases, infectious diseases, as well as cancerous processes; while probe sequences or antibodies may be used for diagnosis of such diseases.

Transcription Factor Binding:

This category contains proteins involved in transcription factors binding, RNA and DNA binding, such as transcription factors, RNA and DNA binding proteins, zinc fingers, helicase, isomerase, histones, nucleases.

Pharmaceutical compositions including such proteins or protein encoding sequences, antibodies directed against such proteins or polynucleotides capable of altering expression of such proteins may be used to treat diseases involving transcription factors binding proteins, for example diseases where there is non-normal replication or transcription of DNA and RNA respectively; while probe sequences or antibodies may be used for diagnosis of such diseases.

Small GTPase Regulatory/Interacting Protein:

This category contains proteins such as RAB escort protein, guanyl-nucleotide exchange factor, guanyl-nucleotide exchange factor adaptor, GDP-dissociation inhibitor, GTPase inhibitor, GTPase activator, guanyl-nucleotide releasing factor, GDP-dissociation stimulator, regulator of G-protein signaling, RAS interactor, RHO interactor, RAB interactor, RAL interactor.

Pharmaceutical compositions including such proteins or protein encoding sequences, antibodies directed against such proteins or polynucleotides capable of altering expression of such proteins may be used to treat diseases in which the signal-transduction, typically involving G-proteases is non-normal, either as a cause, or as a result of the disease; while probe sequences or antibodies may be used for diagnosis of such diseases.

Calcium Binding:

This category contains calcium binding proteins, ligand binding or carriers, such as diacylglycerol kinase, Calpain, calcium-dependent protein serine/threonine phosphatase, calcium sensing proteins, calcium storage proteins.

Oxidoreductase:

This category contains enzymes that catalyze oxidation-reduction reactions, such as oxidoreductases acting on the following groups of donors: CH—OH, CH—CH, CH—NH2, CH—NH; oxidoreductases acting on NADH or NADPH, nitrogenous compounds, sulfur group of donors, heme group, hydrogen group, diphenols and related substances as donors; oxidoreductases acting on peroxide as acceptor, superoxide radicals as acceptor, oxidizing metal ions, CH2 groups; oxidoreductases acting on reduced ferredoxin as donor; oxidoreductases acting on reduced flavodoxin as donor; and oxidoreductases acting on the aldehyde or oxo group of donors.

Pharmaceutical compositions including such proteins or protein encoding sequences, antibodies directed against such proteins or polynucleotides capable of altering expression of such proteins may be used to treat diseases caused by non-normal activity of oxidoreductases; while probe sequences or antibodies may be used for diagnosis of such diseases.

Receptors:

This category contains various receptors, such as signal transducers, complement receptors, ligand-dependent nuclear receptors, transmembrane receptors, GPI-anchored membrane-bound receptors, various coreceptors, internalization receptors, receptors to neurotransmitters, hormones and various other effectors and ligands.

Pharmaceutical compositions including such proteins or protein encoding sequences, antibodies directed against such proteins or polynucleotides capable of altering expression of such proteins may be used to treat diseases caused by non-normal activity of oxidoreductases diseases involving various receptors, including receptors to neurotransmitters, hormones and various other effectors and ligands; while probe sequences or antibodies may be used for diagnosis of such diseases.

Examples of these diseases include, but are not limited to, chronic myelomonocytic leukemia caused by growth factor beta receptor deficiency [Rao D S, Chang J C, Kumar P D, Mizukami I, Smithson G M, Bradley S V, Parlow A F, Ross T S (2001) Mol Cell Biol, 21 (22):7796-806], thrombosis associated with protease-activated receptor deficiency [Sambrano G R, Weiss E J, Zheng Y W, Huang W, Coughlin S R (2001) Nature, 413 (6851):26-7], hypercholesterolemia associated with low density lipoprotein receptor deficiency [Koivisto U M, Hubbard A L, Mellman I (2001) Cell, 105 (5):575-85], familial Hibernian fever associated with tumour necrosis factor receptor deficiency [Simon A, Drenth J P, van der Meer J W (2001) Ned Tijdschr Geneeskd, 145 (2):77-8], colitis associated with immunoglobulin E receptor expression [Dombrowicz D, Nutten S, Desreumaux P, Neut C, Torpier G, Peeters M, Colombel J F, Capron M (2001) J Exp Med, 193 (1):25-34], and alagille syndrome associated with Jagged1 [Stankiewicz P, Rujner J, Loffler C, Kruger A, Nimmakayalu M, Pilacik B, Krajewska-Walasek M, Gutkowska A, Hansmann I, Giannakudis I (2001) Am J Med Genet, 103 (2):166-71].

Protein Serine/Threonine Kinases:

This category contains kinases which phosphorilate serine/threonine residues, mainly involved in signal transduction, such as transmembrane receptor protein serine/threonine kinase, 3-phosphoinositide-dependent protein kinase, DNA-dependent protein kinase, G-protein-coupled receptor phosphorylating protein kinase, SNF1A/AMP-activated protein kinase, casein kinase, calmodulin regulated protein kinase, cyclic-nucleotide dependent protein kinase, cyclin-dependent protein kinase, eukaryotic translation initiation factor 2alpha kinase, galactosyltransferase-associated kinase, glycogen synthase kinase 3, protein kinase C, receptor signaling protein serine/threonine kinase, ribosomal protein S6 kinase, IkB kinase.

Pharmaceutical compositions including such proteins or protein encoding sequences, antibodies directed against such proteins or polynucleotides capable of altering expression of such proteins may be used to treat diseases which may be ameliorated by a modulating kinase activity, which is one of the main signaling pathways inside cell; while probe sequences or antibodies may be used for diagnosis of such diseases.

Channel/Pore Class Transporters:

This category contains proteins that mediate the transport of molecules and macromolecules across membranes, such as alpha-type channels, porins, pore-forming toxins.

Pharmaceutical compositions including such proteins or protein encoding sequences, antibodies directed against such proteins or polynucleotides capable of altering expression of such proteins may be used to treat diseases in which the transport of molecules and macromolecules such as neurotransmitters, hormones, sugar etc. is non-normal leading to various pathologies; while probe sequences or antibodies may be used for diagnosis of such diseases.

Hydrolases, Acting on Acid Anhydrides:

This category contains hydrolytic enzymes that are acting on acid anhydrides, such as hydrolases acting on acid anhydrides, in phosphorus-containing anhydrides, in sulfonyl-containing anhydrides; and hydrolases catalysing transmembrane movement of substances, and involved in cellular and subcellular movement.

Pharmaceutical compositions including such proteins or protein encoding sequences, antibodies directed against such proteins or polynucleotides capable of altering expression of such proteins may be used to treat diseases in which the hydrolase-related activities are non-normal (increased or decreased); while probe sequences or antibodies may be used for diagnosis of such diseases.

Transferases, Transferring Phosphorus-containing Groups:

This category contains various enzymes that catalyze the transfer of phosphate from one molecule to another, such as phosphotransferases using the following groups as acceptors: alcohol group, carboxyl group, nitrogenous group, phosphate; phosphotransferases with regeneration of donors catalysing intramolecular transfers; diphosphotransferases; nucleotidyltransferase; and phosphotransferases for other substituted phosphate groups.

Pharmaceutical compositions including such proteins or protein encoding sequences, antibodies directed against such proteins or polynucleotides capable of altering expression of such proteins may be used to treat diseases in which the transfer of functional group to a modulated moiety is not normal so that a beneficial effect may be achieved by modulation of such transfer; while probe sequences or antibodies may be used for diagnosis of such diseases.

Phosphoric Monoester Hydrolases:

This category contains hydrolytic enzymes that are acting on ester bonds, such as: nuclease, sulfuric ester hydrolase, carboxylic ester hydrolase, thiolester hydrolase, phosphoric monoester hydrolase, phosphoric diester hydrolase, triphosphoric monoester hydrolase, diphosphoric monoester hydrolase, and phosphoric triester hydrolase.

Pharmaceutical compositions including such proteins or protein encoding sequences, antibodies directed against such proteins or polynucleotides capable of altering expression of such proteins may be used to treat diseases in which the hydrolytic cleavage of a covalent bond with accompanying addition of water, —H being added to one product of the cleavage and —OH to the other, is not normal so that a beneficial effect may be achieved by modulation of such reaction; while probe sequences or antibodies may be used for diagnosis of such diseases.

Enzyme Inhibitors:

This category contains inhibitors and suppressors of other proteins and enzymes, such as inhibitors of: kinases, phosphatases, chaperones, guanylate cyclase, DNA gyrase, ribonuclease, proteasome inhibitors, diazepam-binding inhibitor, ornithine decarboxylase inhibitor, GTPase inhibitors, dUTP pyrophosphatase inhibitor, phospholipase inhibitor, proteinase inhibitor, protein biosynthesis inhibitors, alpha-amylase inhibitors.

Pharmaceutical compositions including such proteins or protein encoding sequences, antibodies directed against such proteins or polynucleotides capable of altering expression of such proteins may be used to treat diseases in which beneficial effect may be achieved by modulating the activity of inhibitors and suppressors of proteins and enzymes; while probe sequences or antibodies may be used for diagnosis of such diseases.

Electron Transporters:

This category contains ligand binding or carrier proteins involved in electron transport, such as: flavin-containing electron transporter, cytochromes, electron donors, electron acceptors, electron carriers, and cytochrome-c oxidases.

Transferases, Transferring Glycosyl Groups:

This category contains various enzymes that catalyze the transfer of a chemical group, such as a glycosyl, from one molecule to another. It covers enzymes such as murein lytic endotransglycosylase E, and sialyltransferase.

Pharmaceutical compositions including such proteins or protein encoding sequences, antibodies directed against such proteins or polynucleotides capable of altering expression of such proteins may be used to treat diseases in which the transfer of a glycosyl chemical group from one molecule to another is not normal so that a beneficial effect may be achieved by modulation of such reaction; while probe sequences or antibodies may be used for diagnosis of such diseases.

Ligases, Forming Carbon-oxygen Bonds:

This category contains enzymes that catalyze the linkage between carbon and oxygen, such as ligase forming aminoacyl-tRNA and related compounds.

Pharmaceutical compositions including such proteins or protein encoding sequences, antibodies directed against such proteins or polynucleotides capable of altering expression of such proteins may be used to treat diseases in which the linkage between carbon and oxygen in an energy dependent process is not normal so that a beneficial effect may be achieved by modulation of such reaction; while probe sequences or antibodies may be used for diagnosis of such diseases.

Ligases:

This category contains enzymes that catalyze the linkage of two molecules, generally utilizing ATP as the energy donor, also called synthetase. It covers enzymes such as beta-alanyl-dopamine hydrolase, carbon-oxygen bonds forming ligase, carbon-sulfur bonds forming ligase, carbon-nitrogen bonds forming ligase, carbon-carbon bonds forming ligase, and phosphoric ester bonds forming ligase.

Pharmaceutical compositions including such proteins or protein encoding sequences, antibodies directed against such proteins or polynucleotides capable of altering expression of such proteins may be used to treat diseases in which the joining together of two molecules in an energy dependent process is not normal so that a beneficial effect may be achieved by modulation of such reaction; while probe sequences or antibodies may be used for diagnosis of such diseases.

Hydrolases, Acting on Glycosyl Bonds:

This category contains hydrolytic enzymes that are acting on glycosyl bonds, such as hydrolases hydrolyzing N-glycosyl compounds, S-glycosyl compounds, and O-glycosyl compounds.

Pharmaceutical compositions including such proteins or protein encoding sequences, antibodies directed against such proteins or polynucleotides capable of altering expression of such proteins may be used to treat diseases in which the hydrolase-related activities are non-normal (increased or decreased); while probe sequences or antibodies may be used for diagnosis of such diseases.

Kinases:

This category contains kinases, which phosphorilate serine/threonine or tyrosine residues, mainly involved in signal transduction. It covers enzymes such as 2-amino-4-hydroxy-6-hydroxymethyldihydropteridine pyrophosphokinase, NAD(+) kinase, acetylglutamate kinase, adenosine kinase, adenylate kinase, adenylsulfate kinase, arginine kinase, aspartate kinase, choline kinase, creatine kinase, cytidylate kinase, deoxyadenosine kinase, deoxycytidine kinase, deoxyguanosine kinase, dephospho-CoA kinase, diacylglycerol kinase, dolichol kinase, ethanolamine kinase, galactokinase, glucokinase, glutamate 5-kinase, glycerol kinase, glycerone kinase, guanylate kinase, hexokinase, homoserine kinase, hydroxyethylthiazole kinase, inositol/phosphatidylinositol kinase, ketohexokinase, mevalonate kinase, nucleoside-diphosphate kinase, pantothenate kinase, phosphoenolpyruvate carboxykinase, phosphoglycerate kinase, phosphomevalonate kinase, protein kinase, pyruvate dehydrogenase (lipoamide) kinase, pyruvate kinase, ribokinase, ribose-phosphate pyrophosphokinase, selenide, water dikinase, shikimate kinase, thiamine pyrophosphokinase, thymidine kinase, thymidylate kinase, uridine kinase, xylulokinase, 1D-myo-inositol-trisphosphate 3-kinase, phosphofructokinase, pyridoxal kinase, sphinganine kinase, riboflavin kinase, 2-dehydro-3-deoxygalactonokinase, 2-dehydro-3-deoxygluconokinase, 4-diphosphocytidyl-2C-methyl-D-erythritol kinase, GTP pyrophosphokinase, L-fuculokinase, L-ribulokinase, L-xylulokinase, isocitrate dehydrogenase (NADP+)] kinase, acetate kinase, allose kinase, carbamate kinase, cobinamide kinase, diphosphate-purine nucleoside kinase, fructokinase, glycerate kinase, hydroxymethylpyrimidine kinase, hygromycin-B kinase, inosine kinase, kanamycin kinase, phosphomethylpyrimidine kinase, phosphoribulokinase, polyphosphate kinase, propionate kinase, pyruvate, water dikinase, rhamnulokinase, tagatose-6-phosphate kinase, tetraacyldisaccharide 4'-kinase, thiamine-phosphate kinase, undecaprenol kinase, uridylate kinase, N-acylmannosamine kinase, D-erythro-sphingosine kinase.

Pharmaceutical compositions including such proteins or protein encoding sequences, antibodies directed against such proteins or polynucleotides capable of altering expression of such proteins may be used to treat diseases which may be ameliorated by a modulating kinase activity, which is one of the main signaling pathways inside cell; while probe sequences or antibodies may be used for diagnosis of such diseases.

Examples of these diseases include, but are not limited to, acute lymphoblastic leukemia associated with spleen tyrosine kinase deficiency [Goodman P A, Wood C M, Vassilev A, Mao C, Uckun F M (2001) Oncogene, 20 (30):3969-78], ataxia telangiectasia associated with ATM kinase deficiency (Boultwood J (2001) J Clin Pathol, 54 (7):512-6], congenital haemolytic anaemia associated with erythrocyte pyruvate kinase deficiency [Zanella A, Bianchi P, Fermo E, Iurlo A, Zappa M, Vercellati C, Boschetti C, Baronciani L, Cotton F (2001) Br J Haematol, 113 (1):43-8], mevalonic aciduria caused by mevalonate kinase deficiency [Houten S M, Koster J, Romeijn G J, Frenkel J, Di Rocco M, Caruso U, Landrieu P, Kelley R I, Kuis W, Poll-The B T, Gibson K M, Wanders R J, Waterham H R (2001) Eur J Hum Genet, 9 (4):253-9], and acute myelogenous leukemia associated with over-expressed death-associated protein kinase [Guzman M L, Upchurch D, Grimes B, Howard D S, Rizzieri D A, Luger S M, Phillips G L, Jordan C T (2001) Blood, 97 (7):2177-9].

Nucleotide Binding:

This category contains ligand binding or carrier proteins, involved in physical interaction with a nucleotide—any compound consisting of a nucleoside that is esterified with [ortho] phosphate or an oligophosphate at any hydroxyl group on the glycose moiety, such as purine nucleotide binding proteins.

Tubulin Binding:

This category contains binding proteins that bind tubulin, such as microtubule binding proteins.

Pharmaceutical compositions including such proteins or protein encoding sequences, antibodies directed against such proteins or polynucleotides capable of altering expression of such proteins may be used to treat diseases which are associated with non-normal tubulin activity or structure. Binding of the products of the genes of this family, or antibodies reactive therewith, can modulate a plurality of tubulin activities as well as change microtubulin structure; while probe sequences or antibodies may be used for diagnosis of such diseases.

Examples of these diseases include, but are not limited to, Alzheimer's disease associated with t-complex polypeptide 1 deficiency [Schuller E, Gulesserian T, Seidl R, Cairns N, Lube G (2001) Life Sci, 69 (3):263-70], neurodegeneration associated with apoE deficiency [Masliah E, Mallory M, Ge N, Alford M, Veinbergs I, Roses A D (1995) Exp Neurol, 136 (2): 107-22], progressive axonopathy associated with dysfunctional neurofilaments [Griffiths I R, Kyriakides E, Barrie J (1989) Neuropathol Appl Neurobiol, 15 (1):63-74], familial frontotemporal dementia associated with tau deficiency [astor P, Pastor E, Carnero C, Vela R, Garcia T, Amer G, Tolosa E, Oliva R (2001) Ann Neurol, 49 (2):263-7], and colon cancer suppressed by APC [White R L (1997) Pathol Biol (Paris), 45 (3):240-4].

Receptor Signaling Proteins:

This category contains receptor proteins involved in signal transduction, such as receptor signaling protein serine/threonine kinase, receptor signaling protein tyrosine kinase, receptor signaling protein tyrosine phosphatase, aryl hydrocarbon receptor nuclear translocator, hematopoeitin/interferon-class (D200-domain) cytokine receptor signal transducer, transmembrane receptor protein tyrosine kinase signaling protein, transmembrane receptor protein serine/threonine kinase signaling protein, receptor signaling protein serine/threonine kinase signaling protein, receptor signaling protein serine/threonine phosphatase signaling protein, small GTPase regulatory/interacting protein, receptor signaling protein tyrosine kinase signaling protein, receptor signaling protein serine/threonine phosphatase.

Pharmaceutical compositions including such proteins or protein encoding sequences, antibodies directed against such proteins or polynucleotides capable of altering expression of such proteins may be used to treat diseases in which the signal-transduction is non-normal, either as a cause, or as a result of the disease; while probe sequences or antibodies may be used for diagnosis of such diseases.

Examples of these diseases include, but are not limited to, complete hypogonadotropic hypogonadism associated with GnRH receptor deficiency [Kottler M L, Chauvin S, Lahlou N, Harris C E, Johnston C J, Lagarde J P, Bouchard P, Farid N R, Counis R (2000) J Clin Endocrinol Metab, 85 (9):3002-8], severe combined immunodeficiency disease associated with IL-7 receptor deficiency (Puel A, Leonard W J (2000) Curr Opin Immunol, 12 (4):468-73), schizophrenia associated N-methyl-D-aspartate receptor deficiency (Mohn A R, Gainetdinov R R, Caron M G; Koller B H (1999) Cell, 98 (4):427-36), *Yersinia*-associated arthritis associated with tumor necrosis factor receptor p55 deficiency [Zhao Y X, Zhang H, Chiu B, Payne U, Inman R D (1999) Arthritis Rheum, 42 (8):1662-72], and Dwarfism of Sindh caused by growth hormone-releasing hormone receptor deficiency [aheshwari H G, Silverman B L, Dupuis J, Baumann G (1998) J Clin Endocrinol Metab, 83 (11):4065-74].

Molecular Function Unknown:

This category contains various proteins with unknown molecular function, such as cell surface antigens.

Pharmaceutical compositions including such proteins or protein encoding sequences, antibodies directed against such proteins or polynucleotides capable of altering expression of such proteins may be used to treat diseases in which regulation of the recognition, or participation or bind of cell surface antigens to other moieties may improve the disease. These diseases include autoimmune diseases, various infectious diseases, cancer diseases which involve non cell surface antigens recognition and activity, etc; while probe sequences or antibodies may be used for diagnosis of such diseases.

Enzyme Activators:

This category contains enzyme regulators, such as activators of: kinases, phosphatases, sphingolipids, chaperones, guanylate cyclase, tryptophan hydroxylase, proteases, phospholipases, caspases, proprotein convertase 2 activator, cyclin-dependent protein kinase 5 activator, superoxide-generating NADPH oxidase activator, sphingomyelin phosphodiesterase activator, monophenol monooxygenase activator, proteasome activator, GTPase activator.

Pharmaceutical compositions including such proteins or protein encoding sequences, antibodies directed against such proteins or polynucleotides capable of altering expression of such proteins may be used to treat diseases in which beneficial effect may be achieved by modulating the activity of activators of proteins and enzymes; while probe sequences or antibodies may be used for diagnosis of such diseases.

Transferases, Transferring One-carbon Groups:

This category contains various enzymes that catalyze the transfer of a chemical group, such as a one-carbon, from one molecule to another. The category covers enzymes such as methyltransferase, amidinotransferase, hydroxymethyl-, formyl- and related transferase, carboxyl- and carbamoyltransferase.

Pharmaceutical compositions including such proteins or protein encoding sequences, antibodies directed against such proteins or polynucleotides capable of altering expression of such proteins may be used to treat diseases in which the transfer of a one-carbon chemical group from one molecule to another is not normal so that a beneficial effect may be achieved by modulation of such reaction; while probe sequences or antibodies may be used for diagnosis of such diseases.

Transferases:

This category contains various enzymes that catalyze the transfer of a chemical group, such as a phosphate or amine, from one molecule to another. It covers enzymes such as: transferases, transferring one-carbon groups, aldehyde or ketonic groups, acyl groups, glycosyl groups, alkyl or aryl (other than methyl) groups, nitrogenous, phosphorus-containing groups, sulfur-containing groups, lipoyltransferase, deoxycytidyl transferases.

Pharmaceutical compositions including such proteins or protein encoding sequences, antibodies directed against such proteins or polynucleotides capable of altering expression of such proteins may be used to treat diseases in which the transfer of a chemical group from one molecule to another is not normal so that a beneficial effect may be achieved by modulation of such reaction; while probe sequences or antibodies may be used for diagnosis of such diseases.

Chaperone:

This category contains functional classes of unrelated families of proteins that assist the correct non-covalent assembly of other polypeptide-containing structures in vivo, but are not components of these assembled structures when they a performing their normal biological function. The category covers proteins such as: ribosomal chaperone, peptidylprolyl isomerase, lectin-binding chaperone, nucleosome assembly chaperone, chaperonin ATPase, cochaperone, heat shock protein, HSP70/HSP90 organizing protein, fimbrial chaperone, metallochaperone, tubulin folding, HSC70-interacting protein.

Pharmaceutical compositions including such proteins or protein encoding sequences, antibodies directed against such proteins or polynucleotides capable of altering expression of such proteins may be used to treat diseases which are associated with non-normal protein activity or structure or abnormal degradation of such proteins; while probe sequences or antibodies may be used for diagnosis of such diseases.

Cell Adhesion Molecule:

This category contains proteins that serve as adhesion molecules between adjoining cells, such as: membrane-associated protein with guanylate kinase activity, cell adhesion receptor, neuroligin, calcium-dependent cell adhesion molecule, selectin, calcium-independent cell adhesion molecule, extracellular matrix protein.

Pharmaceutical compositions including such proteins or protein encoding sequences, antibodies directed against such proteins or polynucleotides capable of altering expression of such proteins may be used to treat diseases in which adhesion between adjoining cells is involved, typically conditions in which the adhesion is non-normal; while probe sequences or antibodies may be used for diagnosis of such diseases. Typical examples of such conditions are cancer conditions in which non-normal adhesion may cause and enhance the process of metastasis. Other examples of such conditions include conditions of non-normal growth and development of various tissues in which modulation adhesion among adjoining cells can improve the condition.

Examples of theses diseases include, but are not limited to, Wiskott-Aldrich syndrome associated with WAS deficiency [Westerberg L, Greicius G, Snapper S B, Aspenstrom P, Severinson E (2001) Blood, 98 (4):1086-94], asthma associated with intercellular adhesion molecule-1 deficiency [Tang M L, Fiscus L C (2001) Pulm Pharmacol Ther, 14 (3):203-10], intra-atrial thrombogenesis associated with increased von Willebrand factor activity [Fukuchi M, Watanabe J, Kumagai K, Katori Y, Baba S, Fukuda K, Yagi T, Iguchi A, Yokoyama H, Miura M, Kagaya Y, Sato S, Tabayashi K, Shirato K (2001) J Am Coll Cardiol, 37 (5):1436-42], junctional epidermolysis bullosa associated with laminin 5 beta3 deficiency [Robbins P B, Lin Q, Goodnough J B, Tian H, Chen X, Khavari P A (2001) Proc Natl Acad Sci USA, 98 (9):5193-8], and hydrocephalus caused by neural adhesion molecule L1 deficiency [Rolf B, Kutsche M, Bartsch U (2001) Brain Res, 891 (1-2): 247-52].

Motor Proteins:

This category contains proteins that are held to generate force or energy by the hydrolysis of ATP and that functions in the production of intracellular movement or transportation. It covers proteins such as: microfilament motor, axonemal motor, microtubule motor, and kinetochore motor (like dynein, kinesin, or myosin).

Defense/immunity Proteins:

This category contains proteins that are involved in the immune and complement systems, such as acute-phase response proteins, antimicrobial peptides, antiviral response proteins, blood coagulation factors, complement components, immunoglobulins, major histocompatibility complex antigens, opsonins.

Pharmaceutical compositions including such proteins or protein encoding sequences, antibodies directed against such proteins or polynucleotides capable of altering expression of such proteins may be used to treat diseases involving the immunological system including inflammation, autoimmune diseases, infectious diseases, as well as cancerous processes or diseases which are manifested by non-normal coagulation processes, which may include abnormal bleeding or excessive coagulation.; while probe sequences or antibodies may be used for diagnosis of such diseases.

Examples of these diseases include, but are not limited to, late (C5-9) complement component deficiency associated with opsonin receptor allotypes [Fijen C A, Bredius R C, Kuijper E J, Out T A, De Haas M, De Wit A P, Daha M R, De Winkel J G (2000) Clin Exp Immunol, 120 (2):338-45], combined immunodeficiency associated with defective expression of MHC class II genes [Griscelli C, Lisowska-Grospierre B, Mach B (1989) Immunodefic Rev 1 (2):135-53], loss of antiviral activity of CD4 T cells caused by neutralization of endogenous TNF alpha [Pavic I, Polic B, Crnkovic I, Lucin P, Jonjic S, Koszinowski U H (1993) J Gen Virol, 74 (Pt 10): 2215-23], autoimmune diseases associated with natural resistance-associated macrophage protein deficiency [Evans C A, Harbuz M S, Ostenfeld T, Norrish A, Blackwell J M (2001) Neurogenetics, 3 (2):69-78], and Epstein-Barr virus-associated lymphoproliferative disease inhibited by combined GM-CSF and IL-2 therapy [Baiocchi R A, Ward J S, Carrodeguas L, Eisenbeis C F, Peng R, Roychowdhury S, Vourganti S, Sekula T, O'Brien M, Moeschberger M, Caligiuri M A (2001) J Clin Invest, 108 (6):887-94].

Intracellular Transporters:

This category contains proteins that mediate the transport of molecules and macromolecules inside the cell, such as: intracellular nucleoside transporter, vacuolar assembly proteins, vesicle transporters, vesicle fusion proteins, type II protein secretors.

Pharmaceutical compositions including such proteins or protein encoding sequences, antibodies directed against such proteins or polynucleotides capable of altering expression of such proteins may be used to treat diseases in which the transport of molecules and macromolecules is non-normal leading to various pathologies; while probe sequences or antibodies may be used for diagnosis of such diseases.

Transporters:

This category contains proteins that mediate the transport of molecules and macromolecules, such as channels, exchangers, pumps. The category covers proteins such as:

amine/polyamine transporter, lipid transporter, neurotransmitter transporter, organic acid transporter, oxygen transporter, water transporter, carriers, intracellular transportes, protein transporters, ion transporters, carbohydrate transporter, polyol transporter, amino acid transporters, vitamin/cofactor transporters, siderophore transporter, drug transporter, channel/pore class transporter, group translocator, auxiliary transport proteins, permeases, murein transporter, organic alcohol transporter, nucleobase, nucleoside, nucleotide and nucleic acid transporters.

Pharmaceutical compositions including such proteins or protein encoding sequences, antibodies directed against such proteins or polynucleotides capable of altering expression of such proteins may be used to treat diseases in which the transport of molecules and macromolecules such as neurotransmitters, hormones, sugar etc. is non-normal leading to various pathologies; while probe sequences or antibodies may be used for diagnosis of such diseases.

Examples of these diseases include, but are not limited to, glycogen storage disease caused by glucose-6-phosphate transporter deficiency (Hiraiwa H, Chou J Y (2001) DNA Cell Biol, 20 (8):447-53), tangier disease associated with ATP-binding cassette transporter-1 deficiency (McNeish J, Aiello R J, Guyot D, Turi T, Gabel C, Aldinger C, Hoppe K L, Roach M L, Royer L J, de Wet J, Broccardo C, Chimini G, Francone O L (2000) Proc Natl Acad Sci USA, 97 (8):4245-50), systemic primary carnitine deficiency associated with organic cation transporter deficiency (Tang N L, Ganaphthy V, Wu X, Hui J, Seth P, Yuen P M, Wanders R J, Fok T F, Hjelm N M (1999) Hum Mol Genet, 8 (4):655-60), Wilson disease associated with copper-transporting ATPases deficiency (Payne A S, Kelly E J, Gitlin J D (1998) Proc Natl Acad Sci USA, 95 (18):10854-9), and atelosteogenesis associated with diastrophic dysplasia sulphate transporter deficiency (Newbury-Ecob R (1998) J Med Genet, 35 (1):49-53).

Lyases:

This category contains enzymes that catalyze the formation of double bonds by removing chemical groups from a substrate without hydrolysis or catalyze the addition of chemical groups to double bonds. It covers enzymes such as carbon-carbon lyase, carbon-oxygen lyase, carbon-nitrogen lyase, carbon-sulfur lyase, carbon-halide lyase, phosphorus-oxygen lyase, and other lyases.

Actin Binding Proteins:

This category contains actin binding proteins, such as actin cross-linking, actin bundling, F-actin capping, actin monomer binding, actin lateral binding, actin depolymerizing, actin monomer sequestering, actin filament severing, actin modulating, membrane associated actin binding, actin thin filament length regulation, and actin polymerizing proteins.

Protein Binding Proteins:

This category contains various proteins, involved in diverse biological functions, such as: intermediate filament binding, LIM-domain binding, LLR-domain binding, clathrin binding, ARF binding, vinculin binding, KU70 binding, troponin C binding PDZ-domain binding, SH3-domain binding, fibroblast growth factor binding, membrane-associated protein with guanylate kinase activity interacting, Wnt-protein binding, DEAD/H-box RNA helicase binding, beta-amyloid binding, myosin binding, TATA-binding protein binding DNA topoisomerase I binding, polypeptide hormone binding, RHO binding, FH1-domain binding, syntaxin-1 binding, HSC70-interacting, transcription factor binding, metarhodopsin binding, tubulin binding, JUN kinase binding, RAN protein binding, protein signal sequence binding, importin alpha export receptor, poly-glutamine tract binding, protein carrier, beta-catenin binding, protein C-terminus binding, lipoprotein binding, cytoskeletal protein binding protein, nuclear localization sequence binding, protein phosphatase 1 binding, adenylate cyclase binding, eukaryotic initiation factor 4E binding, calmodulin binding, collagen binding, insulin-like growth factor binding, lamin binding, profilin binding, tropomyosin binding, actin binding, peroxisome targeting sequence binding, SNARE binding, cyclin binding.

Pharmaceutical compositions including such proteins or protein encoding sequences, antibodies directed against such proteins or polynucleotides capable of altering expression of such proteins may be used to treat diseases which are associated with non-normal protein activity or structure. Binding of the products of the variants of this family, or antibodies reactive therewith, can modulate a plurality of protein activities as well as change protein structure; while probe sequences or antibodies may be used for diagnosis of such diseases.

Ligand Binding or Carrier Proteins:

This category contains various proteins, involved in diverse biological functions, such as: pyridoxal phosphate binding, carbohydrate binding, magnesium binding, amino acid binding, cyclosporin A binding, nickel binding, chlorophyll binding, biotin binding, penicillin binding, selenium binding, tocopherol binding, lipid binding, drug binding, oxygen transporter, electron transporter, steroid binding, juvenile hormone binding, retinoid binding, heavy metal binding, calcium binding, protein binding, glycosaminoglycan binding, folate binding, odorant binding, lipopolysaccharide binding, nucleotide binding.

ATPases:

This category contains enzymes that catalyze the hydrolysis of ATP to ADP, releasing energy that is used in the cell; adenosine triphosphatase. It covers enzymes such as plasma membrane cation-transporting ATPase, ATP-binding cassette (ABC) transporter, magnesium-ATPase, hydrogen-/sodium-translocating ATPase, arsenite-transporting ATPase, protein-transporting ATPase, DNA translocase, P-type ATPase, hydrolase, acting on acid anhydrides, —involved in cellular and subcellular movement.

Carboxylic Ester Hydrolases:

This category contains hydrolytic enzymes, acting on carboxylic ester bonds, such as N-acetylglucosaminylphosphatidylinositol deacetylase, 2-acetyl-1-alkylglycerophosphocholine esterase, aminoacyl-tRNA hydrolase, arylesterase, carboxylesterase, cholinesterase, gluconolactonase, sterol esterase, acetylesterase, carboxymethylenebutenolidase, protein-glutamate methylesterase, lipase, 6-phosphogluconolactonase.

Pharmaceutical compositions including such proteins or protein encoding sequences, antibodies directed against such proteins or polynucleotides capable of altering expression of such proteins may be used to treat diseases in which the hydrolytic cleavage of a covalent bond with accompanying addition of water, —H being added to one product of the cleavage and —OH to the other, is not normal so that a beneficial effect may be achieved by modulation of such reaction; while probe sequences or antibodies may be used for diagnosis of such diseases.

Hydrolase, Acting on Ester Bonds:

This category contains hydrolytic enzymes, acting on ester bonds, such as nucleases, sulfuric ester hydrolase, carboxylic ester hydrolases, thiolester hydrolase, phosphoric monoester hydrolase, phosphoric diester hydrolase, triphosphoric monoester hydrolase, diphosphoric monoester hydrolase, phosphoric triester hydrolase.

Pharmaceutical compositions including such proteins or protein encoding sequences, antibodies directed against such proteins or polynucleotides capable of altering expression of such proteins may be used to treat diseases in which the hydrolytic cleavage of a covalent bond with accompanying addition of water, —H being added to one product of the cleavage and —OH to the other, is not normal so that a beneficial effect may be achieved by modulation of such reaction; while probe sequences or antibodies may be used for diagnosis of such diseases.

Hydrolases:

This category contains hydrolytic enzymes, such as GPI-anchor transamidase, peptidases, hydrolases, acting on ester bonds, glycosyl bonds, ether bonds, carbon-nitrogen (but not peptide) bonds, acid anhydrides, acid carbon-carbon bonds, acid halide bonds, acid phosphorus-nitrogen bonds, acid sulfur-nitrogen bonds, acid carbon-phosphorus bonds, acid sulfur-sulfur bonds.

Pharmaceutical compositions including such proteins or protein encoding sequences, antibodies directed against such proteins or polynucleotides capable of altering expression of such proteins may be used to treat diseases in which the hydrolytic cleavage of a covalent bond with accompanying addition of water, —H being added to one product of the cleavage and —OH to the other, is not normal so that a beneficial effect may be achieved by modulation of such reaction; while probe sequences or antibodies may be used for diagnosis of such diseases.

Enzymes:

This category contains naturally occurring or synthetic macromolecular substance composed wholly or largely of protein, that catalyzes, more or less specifically, one or more (bio)chemical reactions at relatively low temperatures. The action of RNA that has catalytic activity (ribozyme) is often also regarded as enzymic. Nevertheless, enzymes are mainly proteinaceous and are often easily inactivated by heating or by protein-denaturing agents. The substances upon which they act are known as substrates, for which the enzyme possesses a specific binding or active site.

This category covers various proteins possessing enzymatic activities, such as mannosylphosphate transferase, para-hydroxybenzoate:polyprenyltransferase, Rieske iron-sulfur protein, imidazoleglycerol-phosphate synthase, sphingosine hydroxylase, tRNA 2'-phosphotransferase, sterol C-24 (28) reductase, C-8 sterol isomerase, C-22 sterol desaturase, C-14 sterol reductase, C-3 sterol dehydrogenase (C-4 sterol decarboxylase), 3-keto sterol reductase, C-4 methyl sterol oxidase, dihydronicotinamide riboside quinone reductase, glutamate phosphate reductase, DNA repair enzyme, telomerase, alpha-ketoacid dehydrogenase, beta-alanyl-dopamine synthase, RNA editase, aldo-keto reductase, alkylbase DNA glycosidase, glycogen debranching enzyme, dihydropterin deaminase, dihydropterin oxidase, dimethylnitrosamine demethylase, ecdysteroid UDP-glucosyl/UDP glucuronosyl transferase, glycine cleavage system, helicase, histone deacetylase, mevaldate reductase, monooxygenase, poly(ADP-ribose) glycohydrolase, pyruvate dehydrogenase, serine esterase, sterol carrier protein X-related thiolase, transposase, tyramine-beta hydroxylase, para-aminobenzoic acid (PABA) synthase, glu-tRNA(gln) amidotransferase, molybdopterin cofactor sulfurase, lanosterol 14-alpha-demethylase, aromatase, 4-hydroxybenzoate octaprenyltransferase, 7,8-dihydro-8-oxoguanine-triphosphatase, CDP-alcohol phosphotransferase, 2,5-diamino-6-(ribosylamino)-4 (3H)-pyrimidonone 5'-phosphate deaminase, diphosphoinositol polyphosphate phosphohydrolase, gamma-glutamyl carboxylase, small protein conjugating enzyme, small protein activating enzyme, 1-deoxyxylulose-5-phosphate synthase, 2'-phosphotransferase, 2-octoprenyl-3-methyl-6-methoxy-1,4-benzoquinone hydroxylase, 2C-methyl-D-erythritol 2,4-cyclodiphosphate synthase, 3,4 dihydroxy-2-butanone-4-phosphate synthase, 4-amino-4-deoxychorismate lyase, 4-diphosphocytidyl-2C-methyl-D-erythritol synthase, ADP-L-glycero-D-manno-heptose synthase, D-erythro-7,8-dihydroneopterin triphosphate 2'-epimerase, N-ethylmaleimide reductase, O-antigen ligase, O-antigen polymerase, UDP-2,3-diacylglucosamine hydrolase, arsenate reductase, carnitine racemase, cobalamin [5'-phosphate] synthase, cobinamide phosphate guanylyltransferase, enterobactin synthetase, enterochelin esterase, enterochelin synthetase, glycolate oxidase, integrase, lauroyl transferase, peptidoglycan synthetase, phosphopantetheinyltransferase, phosphoglucosamine mutase, phosphoheptose isomerase, quinolinate synthase, siroheme synthase, N-acylmannosamine-6-phosphate 2-epimerase, N-acetyl-anhydromuramoyl-L-alanine amidase, carbon-phosphorous lyase, heme-copper terminal oxidase, disulfide oxidoreductase, phthalate dioxygenase reductase, sphingosine-1-phosphate lyase, molybdopterin oxidoreductase, dehydrogenase, NADPH oxidase, naringenin-chalcone synthase, N-ethylammeline chlorohydrolase, polyketide synthase, aldolase, kinase, phosphatase, CoA-ligase, oxidoreductase, transferase, hydrolase, lyase, isomerase, ligase, ATPase, sulfhydryl oxidase, lipoate-protein ligase, delta-1-pyrroline-5-carboxyate synthetase, lipoic acid synthase, and tRNA dihydrouridine synthase.

Pharmaceutical compositions including such proteins or protein encoding sequences, antibodies directed against such proteins or polynucleotides capable of altering expression of such proteins may be used to treat diseases which can be ameliorated by modulating the activity of various enzymes which are involved both in enzymatic processes inside cells as well as in cell signaling; while probe sequences or antibodies may be used for diagnosis of such diseases.

Cytoskeletal Proteins:

This category contains proteins involved in the structure formation of the cytoskeleton.

Pharmaceutical compositions including such proteins or protein encoding sequences, antibodies directed against such proteins or polynucleotides capable of altering expression of such proteins may be used to treat diseases which are caused or due to abnormalities in cytoskeleton, including cancerous cells, and diseased cells including those which do not propagate, grow or function normally; while probe sequences or antibodies may be used for diagnosis of such diseases.

Structural Proteins:

This category contains proteins involved in the structure formation of the cell, such as: structural proteins of ribosome, cell wall structural proteins, structural proteins of cytoskeleton, extracellular matrix structural proteins, extracellular matrix glycoproteins, amyloid proteins, plasma proteins, structural proteins of eye lens, structural protein of chorion (sensu Insecta), structural protein of cuticle (sensu Insecta), puparial glue protein (sensu Diptera), structural proteins of bone, yolk proteins, structural proteins of muscle, structural protein of vitelline membrane (sensu Insecta), structural proteins of peritrophic membrane (sensu Insecta), structural proteins of nuclear pores.

Pharmaceutical compositions including such proteins or protein encoding sequences, antibodies directed against such proteins or polynucleotides capable of altering expression of such proteins may be used to treat diseases which are caused or due to abnormalities in cytoskelaton, including cancerous cells, and diseased cells including those which do not propagate, grow or function normally; while probe sequences or antibodies may be used for diagnosis of such diseases.

Ligands:

This category contains proteins that bind to another chemical entity to form a larger complex, involved in various biological processes, such as signal transduction, metabolism, growth and differentiation, etc. The category covers ligands such as: opioid peptides, baboon receptor ligand, branchless receptor ligand, breathless receptor ligand, ephrin, frizzled receptor ligand, frizzled-2 receptor ligand, heartless receptor ligand, Notch receptor ligand, patched receptor ligand, punt receptor ligand, Ror receptor ligand, saxophone receptor ligand, SE20 receptor ligand, sevenless receptor ligand, smooth receptor ligand, thickveins receptor ligand, Toll receptor ligand, Torso receptor ligand, death receptor ligand, scavenger receptor ligand, neuroligin, integrin ligand, hormones, pheromones, growth factors, sulfonylurea receptor ligand.

Pharmaceutical compositions including such proteins or protein encoding sequences, antibodies directed against such proteins or polynucleotides capable of altering expression of such proteins may be used to treat diseases which involve non-normal secretion of proteins which may be due to non-normal presence, absence or non-normal response to normal levels of secreted proteins including hormones, neurotransmitters, and various other proteins secreted by cells to the extracellular environment or diseases which are endocrine in nature (cause or are a result of hormones); while probe sequences or antibodies may be used for diagnosis of such diseases.

Examples of these diseases include, but are not limited to, analgesia inhibited by orphanin FQ/nociceptin [Shane R, Lazar D A, Rossi G C, Pasternak G W, Bodnar R J (2001) Brain Res, 907 (1-2):109-16], stroke protected by estrogen [Alkayed N J, Goto S, Sugo N, Joh H D, Klaus J, Crain B J, Bernard O, Traystman R J, Hum P D (2001) J Neurosci, 21 (19):7543-50], atherosclerosis associated with growth hormone deficiency [Elhadd T A, Abdu T A, Oxtoby J, Kennedy G, McLaren M, Neary R, Belch J J, Clayton R N (2001) J Clin Endocrinol Metab, 86 (9):4223-32], diabetes inhibited by alpha-galactosylceramide [Hong S, Wilson M T, Serizawa I, Wu L, Singh N, Naidenko O V, Miura T, Haba T, Scherer D C, Wei J, Kronenberg M, Koezuka Y, Van Kaer L (2001) Nat Med, 7 (9):1052-6], and Huntington's disease associated with huntingtin deficiency [Rao D S, Chang J C, Kumar P D, Mizukami I, Smithson G M, Bradley S V, Parlow A F, Ross T S (2001) Mol Cell Biol, 21 (22):7796-806].

Signal Transducer:

This category contains various signal transducers, such as: activin inhibitors, receptor-associated proteins, alpha-2 macroglobulin receptors, morphogens, quorum sensing signal generators, quorum sensing response regulators, receptor signaling proteins, ligands, receptors, two-component sensor molecules, two-component response regulators.

Pharmaceutical compositions including such proteins or protein encoding sequences, antibodies directed against such proteins or polynucleotides capable of altering expression of such proteins may be used to treat diseases in which the signal-transduction is non-normal, either as a cause, or as a result of the disease; while probe sequences or antibodies may be used for diagnosis of such diseases.

Examples of these diseases include, but are not limited to, altered sexual dimorphism associated with signal transducer and activator of transcription 5b [Udy G B, Towers R P, Snell R G, Wilkins R J, Park S H, Ram P A, Waxman D J, Davey H W (1997) Proc Natl Acad Sci USA, 94 (14):7239-44], multiple sclerosis associated with sgp130 deficiency [Padberg F, Feneberg W, Schmidt S, Schwarz M J, Korschenhausen D, Greenberg B D, Nolde T, Muller N, Trapmann H, Konig N, Moller H J, Hampel H (1999) J Neuroimmunol, 99 (2):218-23], intestinal inflammation associated with elevated signal transducer and activator of transcription 3 activity [Suzuki A, Hanada T, Mitsuyama K, Yoshida T, Kamizono S, Hoshino T, Kubo M, Yamashita A, Okabe M, Takeda K, Akira S, Matsumoto S, Toyonaga A, Sata M, Yoshimura A (2001) J Exp Med, 193 (4):471-81], carcinoid tumor inhibited by increased signal transducer and activators of transcription 1 and 2 [Zhou Y, Wang S, Gobl A, Oberg K (2001) Oncology, 60 (4):330-8], and esophageal cancer associated with loss of EGF-STAT1 pathway [Watanabe G, Kaganoi J, Imamura M, Shimada Y. Itami A, Uchida S, Sato F, Kitagawa M (2001) Cancer J, 7 (2):132-9].

RNA Polymerase II Transcription Factors:

This category contains proteins, such as specific and non-specific RNA polymerase II transcription factors, enhancer binding, ligand-regulated transcription factor, general RNA polymerase II transcription factors.

Pharmaceutical compositions including such proteins or protein encoding sequences, antibodies directed against such proteins or polynucleotides capable of altering expression of such proteins may be used to treat diseases involving RNA polymerase II transcription factors, for example diseases where there is non-normal transcription of RNA; while probe sequences or antibodies may be used for diagnosis of such diseases.

RNA Binding Proteins:

This category contains RNA binding proteins involved in splicing and translation regulation, such as tRNA binding proteins, RNA helicases, double-stranded RNA and single-stranded RNA binding proteins, mRNA binding proteins, snRNA cap binding proteins, 5S RNA and 7S RNA binding proteins, poly-pyrimidine tract binding proteins, snRNA binding proteins, and AU-specific RNA binding proteins.

Pharmaceutical compositions including such proteins or protein encoding sequences, antibodies directed against such proteins or polynucleotides capable of altering expression of such proteins may be used to treat diseases involving transcription and translation factors such as: helicases, isomerases, histones and nucleases, for example diseases where there is non-normal transcription, splicing, post-transcriptional processing, translation or stability of the RNA; while probe sequences or antibodies may be used for diagnosis of such diseases.

Nucleic Acid Binding Proteins:

This category contains proteins involved in RNA and DNA synthesis and expression regulation, such as transcription factors, RNA and DNA binding proteins, zinc fingers, helicase, isomerase, histones, nucleases, ribonucleoproteins, transcription and translation factors and other.

Pharmaceutical compositions including such proteins or protein encoding sequences, antibodies directed against such proteins or polynucleotides capable of altering expression of such proteins may be used to treat diseases involving DNA or RNA binding proteins such as: helicases, isomerases, histones and nucleases, for example diseases where there is non-normal replication or transcription of DNA and RNA respectively; while probe sequences or antibodies may be used for diagnosis of such diseases.

Proteins Involved in Metabolism:

The totality of the chemical reactions and physical changes that occur in living organisms, comprising anabolism and catabolism; may be qualified to mean the chemical reactions and physical processes undergone by a particular substance, or class of substances, in a living organism.

This category covers proteins involved in the reactions of cell growth and maintenance, such as: metabolism resulting in cell growth, carbohydrate metabolism, energy pathways, electron transport, nucleobase, nucleoside, nucleotide and nucleic acid metabolism, protein metabolism and modification, amino acid and derivative metabolism, protein targeting, lipid metabolism, aromatic compound metabolism, one-carbon compound metabolism, coenzymes and prosthetic group metabolism, sulfur metabolism, phosphorus metabolism, phosphate metabolism, oxygen and radical metabolism, xenobiotic metabolism, nitrogen metabolism, fat body metabolism (sensu Insecta), protein localization, catabolism, biosynthesis, toxin metabolism, methylglyoxal metabolism, cyanate metabolism, glycolate metabolism, carbon utilization, antibiotic metabolism.

Examples of metabolism-related diseases include, but are not limited to, multisystem mitochondrial disorder caused by mitochondrial DNA cytochrome C oxidase II deficiency [Campos Y, Garcia-Redondo A, Fernandez-Moreno M A, Martinez-Pardo M, Goda G, Rubio J C, Martin M A, del Hoyo P, Cabello A, Bornstein B, Garesse R, Arenas J (2001) Ann Neurol Sep.; 50 (3):409-13], conduction defects and ventricular dysfunction in the heart associated with heterogeneous connexin43 expression [Gutstein D E, Morley G E, Vaidya D, Liu F, Chen F L, Stuhlmann H, Fishman G I (2001) Circulation, 104 (10):1194-9], atherosclerosis associated with growth suppressor p27 deficiency [Diez-Juan A, Andres V (2001) FASEB J, 15 (11):1989-95], colitis associated with glutathione peroxidase deficiency [Esworthy R S, Aranda R, Martin M G, Doroshow J H, Binder S W, Chu F F (2001) Am J Physiol Gastrointest Liver Physiol, 281 (3):G848-55], and systemic lupus erythematosus associated with deoxyribonuclease I deficiency [Yasutomo K, Horiuchi T, Kagami S, Tsukamoto H, Hashimura C, Urushihara M, Kuroda Y (2001) Nat Genet, 28 (4):313-4].

Cell Growth and/or Maintenance Proteins:

This category contains proteins involved in any biological process required for cell survival, growth and maintenance. It covers proteins involved in biological processes such as: cell organization and biogenesis, cell growth, cell proliferation, metabolism, cell cycle, budding, cell shape and cell size control, sporulation (sensu *Saccharomyces*), transport, ion homeostasis, autophagy, cell motility, chemi-mechanical coupling, membrane fusion, cell-cell fusion, stress response.

Pharmaceutical compositions including such proteins or protein encoding sequences, antibodies directed against such proteins or polynucleotides capable of altering expression of such proteins may be used to treat or prevent diseases such as cancer, degenerative diseases, for example neurodegenerative diseases or conditions associated with aging, or alternatively, diseases wherein apoptosis which should have taken place, does not take place; while probe sequences or antibodies may be used for diagnosis of such diseases. Detection of pre-disposition to a disease, as well as for determination of the stage of the disease can also be effected Examples of these diseases include, but are not limited to, ataxia-telangiectasia associated with ataxia-telangiectasia mutated deficiency [Hande et al (2001) Hum Mol Genet, 10 (5):519-28], osteoporosis associated with osteonectin deficiency [Delany et al (2000) J Clin Invest, 105 (7):915-23], arthritis caused by membrane-bound matrix metalloproteinase deficiency [Holmbeck et al (1999) Cell, 99 (1):81-92], defective stratum corneum and early neonatal death associated with transglutaminase 1 deficiency [Matsuki et al (1998) Proc Natl Acad Sci USA, 95 (3):1044-9], and Alzheimer's disease associated with estrogen [Simpkins et al (1997) Am J Med, 103 (3A): 19S-25S].

Thus, the nucleic acid sequences of the present invention and the proteins encoded thereby and the cells and antibodies described hereinabove can be used in, for example, screening assays, therapeutic or prophylactic methods of treatment, or predictive medicine (e.g., diagnostic and prognostic assays, including those used to monitor clinical trials, and pharmacogenetics).

More specifically, the nucleic acids of the invention can be used to: (i) express a protein of the invention in a host cell (in culture or in an intact multicellular organism following, e.g., gene therapy, given, of course, that the transcript in question contains more than untranslated sequence); (ii) detect an mRNA; or (iii) detect an alteration in a gene to which a nucleic acid of the invention specifically binds; or to modulate such a gene's activity.

The nucleic acids and proteins of the invention can also be used to treat disorders characterized by either insufficient or excessive production of those nucleic acids or proteins, a failure in a biochemical pathway in which they normally participate in a cell, or other aberrant or unwanted activity relative to the wild type protein (e.g., inappropriate enzymatic activity or unproductive protein folding). The proteins of the invention are especially useful in screening for naturally occurring protein substrates or other compounds (e.g., drugs) that modulate protein activity. The antibodies of the invention can also be used to detect and isolate the proteins of the invention, to regulate their bioavailability, or otherwise modulate their activity. These uses, and the methods by which they can be achieved, are described in detail below.

Screening Assays

The present invention provides methods (or "screening assays") for identifying agents (or "test compounds" that bind to or otherwise modulate (i.e., stimulate or inhibit) the expression or activity of a nucleic acid of the present invention or the protein it encodes. An agent may be, for example, a small molecule such as a peptide, peptidomimetic (e.g., a peptoid), an amino acid or an analog thereof, a polynucleotide or an analog thereof, a nucleotide or an analog thereof, or an organic or inorganic compound (e.g., a heteroorganic or organometallic compound) having a molecular weight less than about 10,000 (e.g., about 5,000, 1,000, or 500) grams per mole and salts, esters, and other pharmaceutically acceptable forms of such compounds.

Agents identified in the screening assays can be used, for example, to modulate the expression or activity of the nucleic acids or proteins of the invention in a therapeutic protocol, or to discover more about the biological functions of the proteins.

The assays can be constructed to screen for agents that modulate the expression or activity of a protein of the invention or another cellular component with which it interacts. For example, where the protein of the invention is an enzyme, the screening assay can be constructed to detect agents that modulate either the enzyme's expression or activity or that of its substrate. The agents tested can be those obtained from combinatorial libraries. Methods known in the art allow the production and screening of: biological libraries; peptoid libraries [i.e., libraries of molecules that function as peptides even though they have a non-peptide backbone that confers resistance to enzymatic degradation; see, e.g., Zuckermann et al., J. Med. Chem. 37:2678-85, (1994)]; spatially addressable parallel solid phase or solution phase libraries; synthetic libraries requiring deconvolution; "one-bead one-compound" libraries; and synthetic libraries. The biological and peptoid libraries can be used to test only peptides, but the other four are applicable to testing peptides, non-peptide oligomers or libraries of small molecules [Lam, Anticancer Drug Des. 12:145, (1997)]. Molecular libraries can be synthesized as described by DeWitt et al. [Proc. Natl. Acad. Sci. USA 90:6909, (1993)] Erb et al. [Proc. Natl. Acad. Sci. USA 91:11422, (1994)] Zuckermann et al. [J. Med. Chem. 37:2678, (1994)] Cho et al. [Science 261:1303, (1993)] and Gallop et al. [J. Med. Chem. 37:1233, (1994)].

Libraries of compounds may be presented in solution [see, e.g., Houghten, Biotechniques 13:412-421, (1992)], or on beads [Lam, Nature 354:82-84, (1991)], chips [Fodor, Nature 364:555-556, (1993)], bacteria or spores (U.S. Pat. No. 5,223, 409), plasmids [Cull et al., Proc Natl Acad Sci USA 89:1865-1869, (1992)] or on phage [Scott and Smith, Science 249: 386-390, (1990); Devlin, Science 249:404-406, (1990); Cwirla et al., Proc. Natl. Acad. Sci. USA 87:6378-6382, (1990); Felici, J. Mol. Biol. 222:301-310, (1991); and U.S. Pat. No. 5,223,409].

The screening assay can be a cell-based assay, in which case the screening method includes contacting a cell that expresses a protein of the invention with a test compound and determining the ability of the test compound to modulate the protein's activity. The cell used can be a mammalian cell, including a cell obtained from a human or from a human cell line.

Alternatively, or in addition to examining the ability of an agent to modulate expression or activity generally, one can examine the ability of an agent to interact with, for example, to specifically bind to, a nucleic acid or protein of the invention. For example, one can couple an agent (e.g., a substrate) to a label (those described above, including radioactive or enzymatically active substances, are suitable), contact the nucleic acid or protein of the invention with the labeled agent, and determine whether they bind one another (by detecting, for example, a complex containing the nucleic acid or protein and the labeled agent). Labels are not, however, always required. For example, one can use a microphysiometer to detect interaction between an agent and a protein of the invention, neither of which were previously labeled [McConnell et al., Science 257:1906-1912, (1992). A microphysiometer (also known as a cytosensor) is an analytical instrument that measures the rate at which a cell acidifies its environment. The instrument uses a light-addressable potentiometric sensor (LAPS), and changes in the acidification rate indicate interaction between an agent and a protein of the invention. Molecular interactions can also be detected using fluorescence energy transfer (FET; see, e.g., U.S. Pat. Nos. 5,631, 169 and 4,868,103). An FET binding event can be conveniently measured through fluorometric detection means well known in the art (e.g., by means of a fluorimeter). Where analysis in real time is desirable, one can examine the interaction (e.g., binding) between an agent and a protein of the invention with Biomolecular Interaction Analysis [BIA; see, e.g., Sjolander and Urbaniczky Anal. Chem. 63:2338-2345, (1991) and Szabo et al., Curr. Opin. Struct. Biol. 5:699-705, (1995)]. BIA allows one to detect biospecific interactions in real time without labeling any of the interactants (e.g., BIAcore).

The screening assays can also be cell-free assays (i.e., soluble or membrane-bound forms of the proteins of the invention, including the variants, mutants, and other fragments described above, can be used to identify agents that bind those proteins or otherwise modulate their expression or activity). The basic protocol is the same as that for a cell-based assay in that, in either case, one must contact the protein of the invention with an agent of interest [for a sufficient time and under appropriate (e.g., physiological) conditions] to allow any potential interaction to occur and then determine whether the agent binds the protein or otherwise modulates its expression or activity.

Those of ordinary skill in the art will, however, appreciate that there are differences between cell-based and cell-free assays. For example, when membrane-bound forms of the protein are used, it may be desirable to utilize a solubilizing agent (e.g., non-ionic detergents such as n-octylglucoside, n-dodecylglucoside, n-dodecylmaltoside, octanoyl-N-methylglucamide, decanoyl-N-methylglucamide, Triton® X-100, Triton® X-114, Thesit®, Isotridecypoly(ethylene glycol ether)$_n$, 3-[(3-cholamidopropyl)dimethylamminio]-1-propane sulfonate (CHAPS), 3-[(3-cholamidopropyl)dimethylamminio]-2-hydroxy-1-propane sulfonate (CHAPSO), or N-dodecyl=N,N-dimethyl-3-ammonio-1-propane sulfonate).

In the assays of the invention, any of the proteins described herein or the agents being tested can be anchored to a solid phase or otherwise immobilized (assays in which one of two substances that interact with one another are anchored to a solid phase are sometimes referred to as "heterogeneous" assays). For example, a protein of the present invention can be anchored to a microtiter plate, a test tube, a microcentrifuge tube, a column, or the like before it is exposed to an agent. Any complex that forms on the solid phase is detected at the end of the period of exposure. For example, a protein of the present invention can be anchored to a solid surface, and the test compound (which is not anchored and can be labeled, directly or indirectly) is added to the surface bearing the anchored protein. Un-reacted (e.g., unbound) components can be removed (by, e.g., washing) under conditions that allow any complexes formed to remain immobilized on the solid surface, where they can be detected (e.g., by virtue of a label attached to the protein or the agent or with a labeled antibody that specifically binds an immobilized component and may, itself, be directly or indirectly labeled).

One can immobilize either a protein of the present invention or an antibody to which it specifically binds to facilitate separation of complexed (or bound) protein from uncomplexed (or unbound) protein. Such immobilization can also make it easier to automate the assay, and fusing the proteins of the invention to heterologous proteins can facilitate their immobilization. For example, proteins fused to glutathione-S-transferase can be adsorbed onto glutathione sepharose beads (Sigma Chemical Co., St. Louis, Mo.) or glutathione derivatized microtiter plates, then combined with the agent and incubated under conditions conducive to complex formation (e.g., conditions in which the salt and pH levels are within physiological levels). Following incubation, the solid phase is washed to remove any unbound components (where the solid phase includes beads, the matrix can be immobilized), the presence or absence of a complex is determined. Alternatively, complexes can be dissociated from a matrix, and the level of protein binding or activity can be determined using standard techniques.

Immobilization can be achieved with methods known in the art. For example, biotinylated protein can be prepared from biotin-NHS(N-hydroxy-succinimide) using techniques known in the art (e.g., the biotinylation kit from Pierce Chemicals, Rockford, Ill.) and immobilized in the wells of streptavidin-coated tissue culture plates (also from Pierce Chemical).

The screening assays of the invention can employ antibodies that react with the proteins of the invention but do not interfere with their activity. These antibodies can be derivatized to a solid surface, where they will trap a protein of the invention. Any interaction between a protein of the invention and an agent can then be detected using a second antibody that specifically binds the complex formed between the protein of the invention and the agent to which it is bound.

Cell-free assays can also be conducted in a liquid phase, in which case any reaction product can be separated (and thereby detected) by, for example: differential centrifugation (Rivas and Minton, Trends Biochem Sci 18:284-7, 1993); chromatography (e.g., gel filtration or ion-exchange chromatography); electrophoresis [see, e.g., Ausubel et al., Eds., Current Protocols in Molecular Biology, J. Wiley & Sons, New York, N.Y., (1999)]; or immunoprecipitation [see, e.g., Ausubel et al. (supra); see also Heegaard, J. Mol. Recognit. 11:141-148, (1998) and Hage and Tweed, J. Chromatogr. Biomed. Sci. Appl. 699:499-525, (1997)]. Fluorescence energy transfer (see above) can also be used, and is convenient because binding can be detected without purifying the complex from solution. Assays in which the entire reaction of interest is carried out in a liquid phase are sometimes referred to as homogeneous assays.

The screening methods of the invention can also be designed as competition assays in which an agent and a substance that is known to bind a protein of the present invention compete to bind that protein. Depending upon the order of addition of reaction components and the reaction conditions (e.g., whether the reaction is allowed to reach equilibrium), agents that inhibit complex formation can be distinguished from those that disrupt preformed complexes.

In either approach, the order in which reactants are added can be varied to obtain different information about the agents being tested. For example, agents that interfere with the interaction between a gene product and one or more of its binding partners (by, e.g., competing with the binding partner), can be identified by adding the binding partner and the agent to the reaction at about the same time. Agents that disrupt preformed complexes (by, e.g., displacing one of the components from the complex), can be added after a complex containing the gene product and its binding partner has formed.

The proteins of the invention can also be used as "bait proteins" in a two- or three-hybrid assay [see, e.g., U.S. Pat. No. 5,283,317; Zervos et al., Cell 72:223-232, (1993); Madura et al., J. Biol. Chem. 268:12046-12054, (1993); Bartel et al. Biotechniques 14:920-924, (1993); Iwabuchi et al., Oncogene 8:1693-1696, (1993); and WO 94/10300] to identify other proteins that bind to (e.g., specifically bind to) or otherwise interact with a protein of the invention. Such binding proteins can activate or inhibit the proteins of the invention (and thereby influence the biochemical pathways and events in which those proteins are active).

As noted above, the screening assays of the invention can be used to identify an agent that inhibits the expression of a protein of the invention by, for example, inhibiting the transcription or translation of a nucleic acid that encodes it. In these assays, one can contact a cell or cell free mixture with the agent and then evaluate mRNA or protein expression relative to the levels that are observed in the absence of the agent (a statistically significant increase in expression indicating that the agent stimulates mRNA or protein expression and a decrease (again, one that is statistically significant) indicating tat the agent inhibits mRNA or protein expression). Methods for determining levels of mRNA or protein expression are known in the art and, here, would employ the nucleic acids, proteins, and antibodies of the present invention.

It should be noted that if desired, two or more of the methods described herein can be practiced together. For example, one can evaluate an agent that was first identified in a cell-based assay in a cell free assay. Similarly, and the ability of the agent to modulate the activity of a protein of the invention can be confirmed in vivo (e.g., in a transgenic animal).

The screening methods of the present invention can also be used to identify proteins (in the event transcripts of the present invention encode proteins) that are associated (e.g., causally) with drug resistance. One can then block the activity of these proteins (with, e.g., an antibody of the invention) and thereby improve the ability of a therapeutic agent to exert a desirable effect on a cell or tissue in a subject (e.g., a human patient).

Monitoring the influence of therapeutic agents (e.g., drugs) or other events (e.g., radiation therapy) on the expression or activity of a biomolecular sequence of the present invention can be useful in clinical trials (a desired extension of the screening assays described above). For example, agents that exert an effect by, in part, altering the expression or activity of a protein of the invention ex vivo can be tested for their ability to do so as the treatment progresses in a subject. Moreover, in animal or clinical trials, the expression or activity of a nucleic acid can be used, optionally in conjunction with that of other genes, as a "read out" or marker of the phenotype of a particular cell.

Detection Assays

The nucleic acid sequences of the invention can serve as polynucleotide reagents that are useful in detecting a specific nucleic acid sequence. For example, one can use the nucleic acid sequences of the present invention to map the corresponding genes on a chromosome (and thereby discover which proteins of the invention are associated with genetic disease) or to identify an individual from a biological sample (i.e., to carry out tissue typing, which is useful in criminal investigations and forensic science). The novel transcripts of the present invention can be used to identify those tissues or cells affected by a disease (e.g., the nucleic acids of the invention can be used as markers to identify cells, tissues, and specific pathologies, such as cancer), and to identify individuals who may have or be at risk for a particular cancer. Specific methods of detection are described herein and are known to those of ordinary skill in the art.

The nucleic acids of the present invention can be used to determine whether a particular individual is the source of a biological sample (e.g., a blood sample). This is presently achieved by examining restriction fragment length polymorphisms (RFLPs; U.S. Pat. No. 5,272,057), and the sequences disclosed here are useful as additional DNA markers for RFLP. For example, one can digest a sample of an individual's genomic DNA, separate the fragments (e.g. by Southern blotting), and expose the fragments to probes generated from the nucleic acids of the present invention (methods employing restriction endonucleases are discussed further below). If the pattern of binding matches that obtained from a tissue of an unknown source, then the individual is the source of the tissue.

The nucleic acids of the present invention can also be used to determine the sequence of selected portions of an individual's genome. For example, the sequences that represent new genes can be used to prepare primers that can be used to amplify an individual's DNA and subsequently sequence it. Panels of DNA sequences (each amplified with a different set of primers) can uniquely identify individuals (as every person will have unique sequences due to allelic differences).

Allelic variation occurs to some degree in the coding regions of these sequences, and to a greater degree in the noncoding regions. Each of the sequences described herein can, to some degree, be used as a standard against which DNA from an individual can be compared for identification purposes. Because greater numbers of polymorphisms occur in the noncoding regions, fewer sequences are necessary to differentiate individuals. The noncoding sequences disclosed herein can provide positive individual identification with a panel of perhaps 10 to 1,000 primers which each yield a noncoding amplified sequence of 100 bases. If predicted coding sequences are used, a more appropriate number of primers for positive individual identification would be 500-2,000.

If a panel of reagents from the nucleic acids described herein is used to generate a unique identification database for an individual, those same reagents can later be used to identify tissue from that individual. Using the database, the individual, whether still living or dead, can subsequently be linked to even very small tissue samples.

DNA-based identification techniques, including those in which small samples of DNA are amplified (e.g., by PCR) can also be used in forensic biology. Sequences amplified from tissues (such as hair or skin) or body fluids (such as blood, saliva, or semen) found at a crime scene can be compared to a standard (e.g., sequences obtained and amplified from a suspect), thereby allowing one to determine whether the suspect is the source of the tissue or bodily fluid.

The nucleic acids of the invention, when used as probes or primers, can target specific loci in the human genome. This will improve the reliability of DNA-based forensic identifications because the more identifying markers examined, the less likely it is that one individual will be mistaken for another. Moreover, tests that rely on obtaining actual genomic sequence (which is possible here) are more accurate than those in which identification is based on the patterns formed by restriction enzyme generated fragments.

The nucleic acids of the invention can also be used to study the expression of the mRNAs in histological sections (i.e., they can be used in in situ hybridization). This approach can be useful when forensic pathologists are presented with tissues of unknown origin or when the purity of a population of cells (e.g., a cell line) is in question. The nucleic acids can also be used in diagnosing a particular condition and in monitoring a treatment regime.

Predictive Medicine

The nucleic acids, proteins, antibodies, and cells described hereinabove are generally useful in the field of predictive medicine and, more specifically, are useful in diagnostic and prognostic assays and in monitoring clinical trials. For example, one can determine whether a subject is at risk of developing a disorder associated with a lesion in, or the mis-expression of, a nucleic acid of the invention (e.g., a cancer such as pancreatic cancer, breast cancer, or a cancer within the urinary system). In addition, the nucleic acids expressed in tumor tissues and not in normal tissues are markers that can be used to determine whether a subject has or is likely to develop a particular type of cancer.

The "subject" referred to in the context of any of the methods of the present invention, is a vertebrate animal (e.g., a mammal such as an animal commonly used in experimental studies (e.g. rats, mice, rabbits and guinea pigs); a domesticated animal (e.g., a dog or cat); an animal kept as livestock (e.g., a pig, cow, sheep, goat, or horse); a non-human primate (e.g. an ape, monkey, or chimpanzee); a human primate; an avian (e.g., a chicken); an amphibian (e.g., a frog); or a reptile. The animal can be an unborn animal (accordingly, the methods of the invention can be used to carry out genetic screening or to make prenatal diagnoses). The subject can also be a human.

The methods related to predictive medicine can also be carried out by using a nucleic acid of the invention to, for example detect, in a tissue of a subject: (i) the presence or absence of a mutation that affects the expression of the corresponding gene (e.g., a mutation in the 5' regulatory region of the gene); (ii) the presence or absence of a mutation that alters the structure of the corresponding gene; (iii) an altered level (i.e., a non-wild type level) of mRNA of the corresponding gene (the proteins of the invention can be similarly used to detect an altered level of protein expression); (iv) a deletion or addition of one or more nucleotides from the nucleic acid sequences of the present invention; (v) a substitution of one or more nucleotides in the nucleic acid sequences of the present invention (e.g., a point mutation); (vi) a gross chromosomal rearrangement (e.g., a translocation, inversion, or deletion); or (vii) aberrant modification of a gene corresponding to the nucleic acid sequences of the present invention (e.g., modification of the methylation pattern of the genomic DNA). Similarly, one can test for inappropriate post-translational modification of any protein encoded. Abnormal expression or abnormal gene or protein structures indicate that the subject is at risk for the associated disorder.

A genetic lesion can be detected by, for example, providing an oligonucleotide probe or primer having a sequence that hybridizes to a sense or antisense strand of a nucleic acid sequence of the present invention, a naturally occurring mutant thereof, or the 5' or 3' sequences that are naturally associated with the corresponding gene, and exposing the probe or primer to a nucleic acid within a tissue of interest (e.g., a tumor). One can detect hybridization between the probe or primer and the nucleic acid of the tissue by standard methods (e.g., in situ hybridization) and thereby detect the presence or absence of the genetic lesion. Where the probe or primer specifically hybridizes with a new splice variant, the probe or primer can be used to detect a non-wild type splicing pattern of the mRNA. The antibodies of the invention can be similarly used to detect the presence or absence of a protein encoded by a mutant, mis-expressed, or otherwise deficient gene. Diagnostic and prognostic assays are described further below.

Qualitative or quantitative analyses (which reveal the presence or absence of a substance or its level of expression or activity, respectively) can be carried out for any one of the nucleic acid sequences of the present invention, or (where the nucleic acid encodes a protein) the proteins they encode, by obtaining a biological sample from a subject and contacting the sample with an agent capable of specifically binding a nucleic acid represented by the nucleic acid sequences of the present invention or a protein those nucleic acids encode. The conditions in which contacting is performed should allow for specific binding. Suitable conditions are known to those of ordinary skill in the art. The biological sample can be a tissue, a cell, or a bodily fluid (e.g., blood or serum), which may or may not be extracted from the subject (i.e., expression can be monitored in vivo).

More specifically, the expression of a nucleic acid sequence can be examined by, for example, Southern or Northern analyses, polymerase chain reaction analyses, or with probe arrays. For example, one can diagnose a condition associated with expression or mis-expression of a gene by isolating mRNA from a cell and contacting the mRNA with a nucleic acid probe with which it can hybridize under stringent conditions (the characteristics of useful probes are known to those of ordinary skill in the art and are discussed elsewhere herein). The mRNA can be immobilized on a surface (e.g., a membrane, such as nitrocellulose or other commercially available membrane) following gel electrophoresis.

Alternatively, one or more nucleic acids (the target sequence or the probe) can be distributed on a two-dimensional array (e.g., a gene chip). Arrays are useful in detecting mutations because a probe positioned on the array can have one or more mismatches to a nucleic acid of the invention (e.g., a destabilizing mismatch). For example, genetic mutations in any of nucleic acid sequences of the present invention can be identified in two-dimensional arrays containing light-generated DNA probes [Cronin et al., Human Mutation 7:244-255, (1996)]. Briefly, when a light-generated DNA probe is used, a first array of probes is used to scan through long stretches of DNA in a sample and a control to identify base changes between the sequences by making linear arrays of sequential overlapping probes. This step allows the identification of point mutations, and it can be followed by use of a second array that allows the characterization of specific mutations by using smaller, specialized probe arrays complementary to all variants or mutations detected. Each mutation array is composed of parallel probe sets, one complementary to the wild-type gene and the other complementary to the mutant gene. Arrays are discussed further below; see also; Kozal et al. [Nature Medicine 2:753-759, (1996)].

The level of an mRNA in a sample can also be evaluated with a nucleic acid amplification technique e.g., RT-PCR (U.S. Pat. No. 4,683,202), ligase chain reaction [LCR; Barany, Proc. Natl. Acad. Sci. USA 88:189-193, (1991)]; LCR can be particularly useful for detecting point mutations), self sustained sequence replication [Guatelli et al., Proc. Natl. Acad. Sci. USA 87:1874-1878, (1990)], transcriptional amplification system [Kwoh et al., Proc. Natl. Acad. Sci. USA 86:1173-1177, (1989)], Q-Beta Replicase [Lizardi et al., Bio/Technology 6:1197, (1988)], or rolling circle replication (U.S. Pat. No. 5,854,033). Following amplification, the nucleic acid can be detected using techniques known in the art. Amplification primers are a pair of nucleic acids that anneal to 5' or 3' regions of a gene (plus and minus strands, respectively, or vice-versa) at some distance (possibly a short distance) from one another. For example, each primer can consist of about 10 to 30 nucleotides and bind to sequences that are about 50 to 200 nucleotides apart. Serial analysis of gene expression can be used to detect transcript levels (U.S. Pat. No. 5,695,937). Other useful amplification techniques (useful in, for example, detecting an alteration in a gene) include anchor PCR or RACE PCR.

Mutations in the gene sequences of the invention can also be identified by examining alterations in restriction enzyme cleavage patterns. For example, one can isolate DNA from a sample cell or tissue and a control, amplify it (if necessary), digest it with one or more restriction endonucleases, and determine the length(s) of the fragment(s) produced (e.g., by gel electrophoresis). If the size of the fragment obtained from the sample is different from the size of the fragment obtained from the control, there is a mutation in the DNA in the sample tissue. Sequence specific ribozymes (see, for example, U.S. Pat. No. 5,498,531) can be used to detect specific mutations by development or loss of a ribozyme cleavage site.

Any sequencing reaction known in the art (including those that are automated) can also be used to determine whether there is a mutation, and, if so, how the mutant differs from the wild type sequence. Mutations can also be identified by using cleavage agents to detect mismatched bases in RNA/RNA or RNA/DNA duplexes [Myers et al., Science 230:1242, (1985); Cotton et al., Proc. Natl. Acad. Sci. USA 85:4397, (1988); Saleeba et al., Methods Enzymol. 217:286-295, (1992)]. Mismatch cleavage reactions employ one or more proteins that recognize mismatched base pairs in double-stranded DNA (so called "DNA mismatch repair" enzymes; e.g., the mutY enzyme of E. coli cleaves A at G/A mismatches and the thymidine DNA glycosylase from HeLa cells cleaves T at G/T mismatches [see Hsu et al., Carcinogenesis 15:1657-1662, (1994) and U.S. Pat. No. 5,459,039].

Alterations in electrophoretic mobility can also be used to identify mutations. For example, single strand conformation polymorphism (SSCP) can be used to detect differences in electrophoretic mobility between mutant and wild type nucleic acids [Orita et al., Proc. Natl. Acad. Sci. USA 86:2766, (1989); see also Cotton Mutat. Res. 285:125-144, (1993); and Hayashi, Genet. Anal. Tech. Appl. 9:73-79, (1992)]. Single-stranded DNA fragments of sample and control nucleic acids are denatured and allowed to renature. The secondary structure of single-stranded nucleic acids varies according to sequence, and the resulting alteration in electrophoretic mobility enables the detection of even a single base change. The sensitivity of the assay is enhanced when RNA (rather than DNA) is used because RNA's secondary structure is more sensitive to a change in sequence. See also Keen et al., Trends Genet. 7:5, (1991). The movement of mutant or wild-type fragments through gels containing a gradient of denaturant is also informative.

When denaturing gradient gel electrophoresis [DGGE; Myers et al., Nature 313:495, (1985)] is used, DNA can be modified so it will not completely denature (this can be done by, for example by adding a GC clamp of approximately 40 bp of high-melting GC-rich DNA by PCR). A temperature gradient can be used in place of a denaturing gradient to identify differences in the mobility of control and sample DNA [Rosenbaum and Reissner, Biophys. Chem. 265:12753, (1987)].

Point mutations can also be detected by selective oligonucleotide hybridization, selective amplification, or selective primer extension [Point et al., Nature 324:163, (1986); Saiki et al., Proc. Natl. Acad. Sci. USA 86:6230, (1989)] or by chemical ligation of oligonucleotides as described in Xu et al., Nature Biotechnol. 19:148, (2001). Allele specific amplification technology can also be used [see, e.g., Gibbs et al., Nucleic Acids Res. 17:2437-2448, (1989); Prossner, Tibtech. 11:238, (1993); and Barany, Proc. Natl. Acad. Sci. USA 88:189, (1991)].

When analysis of a gene or protein is carried out in a cell or tissue sample, the cell or tissue can be immobilized on a support, typically a glass slide, and then contacted with a probe that can hybridize to the nucleic acid or protein of interest.

The detection methods of the invention can be carried out with appropriate controls (e.g., analyses can be conducted in parallel with a sample known to contain the target sequence and a target known to lack it).

Various approaches can be used to determine protein expression or activity. For example, one can evaluate the amount of protein in a sample by exposing the sample to an antibody that specifically binds the protein of interest. The antibodies described above (e.g., monoclonal antibodies, detectably labeled antibodies, intact antibodies and fragments thereof) can be used. The methods can be carried out in-vitro (e.g., one can perform an enzyme linked immunosorbent assay (ELISA), an immunoprecipitation, an immunofluorescence analysis, an enzyme immunoassay (EIA), a radioimmunoassay (RIA), or a Western blot analysis) or in vivo (e.g., one can introduce a labeled antibody that specifically binds to a protein of the present invention into a subject and then detect it by a standard imaging technique). Alternatively, the sample can be labeled and then contacted with an antibody. For example, one can biotinylate the sample, contact it with an antibody (e.g., an antibody positioned on an antibody array) and then detect the bound sample (e.g., with avidin coupled to a fluorescent label). As with methods to detect nucleic acids, appropriate control studies can be performed in parallel with those designed to detect protein expression.

The diagnostic molecules disclosed herein can be assembled as kits. Accordingly, the invention features kits for detecting the presence of the biomolecular sequences of the present invention in a biological sample. The kit can include a probe (e.g., a nucleic acid sequence or an antibody), a standard and, optionally, instructions for use. More specifically, antibody-based kits can include a first antibody (e.g., in solution or attached to a solid support) that specifically binds a protein of the present invention and, optionally, a second, different antibody that specifically binds to the first antibody and is conjugated to a detectable agent. Oligonucleotide-based kits can include an oligonucleotide (e.g., a labeled oligonucleotide) that hybridizes with one of the nucleic acids of the present invention under stringent conditions or a pair of oligonucleotides that can be used to amplify a nucleic acid sequence of the present invention. The kits can also include a buffering agent, a preservative, a protein-stabilizing agent, or a component necessary for detecting any included label (e.g., an enzyme or substrate). The kits can also contain a control sample or a series of control samples that can be assayed and compared to the test sample contained. Each component of the kit can be enclosed within an individual container, and all of the various containers can be within a single package.

The detection methods described herein can identify a subject who has, or is at risk of developing, a disease, disorder, condition, or syndrome (the term "disease" is used to encompass all deviations from a normal state) associated with aberrant or unwanted expression or activity of a biomolecular sequence of the present invention. The detection methods also have prognostic value (e.g., they can be used to determine whether or not it is likely that a subject will respond positively (i.e., be effectively treated with) to an agent (e.g., a nucleic acid, protein, small molecule or other drug)). Samples can also be obtained from a subject during the course of treatment to monitor the treatment's efficacy at a cellular level.

The present invention also features methods of evaluating a sample by creating a gene expression profile for the sample that includes the level of expression of one or more of biomolecular sequences of the present invention. The sample's profile can be compared with that of a reference profile, either of which can be obtained by the methods described herein (e.g., by obtaining a nucleic acid from the sample and contacting the nucleic acid with those on an array). As with other detection methods, profile-based assays can be performed prior to the onset of symptoms (in which case they can be diagnostic), prior to treatment (in which case they can be predictive) or during the course of treatment (in which case they serve as monitors) [see, e.g., Golub et al., Science 286: 531, (1999)].

As described hereinabove, the screening methods of the invention can be used to identify candidate therapeutic agents, and those agents can be evaluated further by examining their ability to alter the expression of one or more of the proteins of the invention. For example, one can obtain a cell from a subject, contact the cell with the agent, and subsequently examine the cell's expression profile with respect to a reference profile (which can be, for example, the profile of a normal cell or that of a cell in a physiologically acceptable condition). The agent is evaluated favorably if the expression profile in the subject's cell is, following exposure to the agent, more similar to that of a normal cell or a cell in a physiologically acceptable condition. A control assay can be performed with, for example, a cell that is not exposed to the agent.

Expression profiles (obtained by evaluating either nucleic acid or protein expression) are also useful in evaluating subjects. One can obtain a sample from a subject (either directly or indirectly from a caregiver), create an expression profile, and, optionally, compare the subject's expression profile to one or more reference profiles and/or select a reference profile most similar to that of the subject. A variety of routine statistical measures can be used to compare two reference profiles. One possible metric is the length of the distance vector that is the difference between the two profiles. Each of the subject and reference profile is represented as a multi-dimensional vector, wherein each dimension is a value in the profile.

The result, which can be communicated to the subject, a caregiver, or another interested party, can be the subject's expression profile per se, a result of a comparison of the subject's expression profile with another profile, a most similar reference profile, or a descriptor of any of these. Communication can be mediated by a computer network (e.g., in the form of a computer transmission such as a computer data signal embedded in a carrier wave).

Accordingly, the invention also features a computer medium having executable code for effecting the following steps: receive a subject expression profile; access a database of reference expression profiles; and either i) select a matching reference profile most similar to the subject expression profile, or ii) determine at least one comparison score for the similarity of the subject expression profile to at least one reference profile. The subject expression profile and the reference expression profile each include a value representing the level of expression of one or more of the biomolecular sequences of the present invention.

Arrays and Uses Thereof

The present invention also encompasses arrays that include a substrate having a plurality of addresses, at least one of which includes a capture probe that specifically binds or hybridizes to a nucleic acid represented by any one of the biomolecular sequences of the present invention. The array can have a density of at least 10, 50, 100, 200, 500, 1,000, 2,000, or 10,000 or more addresses/$cm^2$, or densities between these. In some embodiments, the plurality of addresses includes at least 10, 100, 500, 1,000, 5,000, 10,000, or 50,000 addresses, while in other embodiments, the plurality of addresses can be equal to, or less than, those numbers.

Regardless of whether the array contains nucleic acids (as probes or targets) or proteins (as probes or targets), the substrate can be two-dimensional (formed, e.g., by a glass slide, a wafer (e.g., silica or plastic), or a mass spectroscopy plate) or three-dimensional (formed, e.g., by a gel or pad). Addresses in addition to the addresses of the plurality can be disposed on the array.

At least one address of the plurality can include a nucleic acid capture probe that hybridizes specifically to one or more of the nucleic acid sequences of the present invention. In certain embodiments, a subset of addresses of the plurality will be occupied by a nucleic acid capture probe for one of the nucleic acid sequences of the present invention; each address in the subset can bear a capture probe that hybridizes to a different region of a selected nucleic acid. In other embodiments, the probe at each address is unique, overlapping, and complementary to a different variant of a selected nucleic acid (e.g., an allelic variant, or all possible hypothetical variants). If desired, the array can be used to sequence the selected nucleic acid by hybridization (see, e.g., U.S. Pat. No. 5,695, 940). Alternatively, the capture probe can be a protein that specifically binds to a protein of the present invention or a fragment thereof (e.g., a naturally-occurring interaction partners of a protein of the invention or an antibody described herein). In some instances (e.g., in the event of an autoimmune disease), it is significant that a subject produces antibodies, and the arrays described herein can be used to detect those antibodies. More generally, an array that contains some or all of the proteins of the present invention can be used to detect any substance to which one or more those proteins bind (e.g., a natural binding partner, an antibody, or a synthetic molecule).

An array can be generated by methods known to those of ordinary skill in the art. For example, an array can be generated by photolithographic methods (see, e.g., U.S. Pat. Nos. 5,143,854; 5,510,270; and 5,527,681), mechanical methods (e.g., directed-flow methods as described in U.S. Pat. No. 5,384,261), pin-based methods (e.g., as described in U.S. Pat. No. 5,288,514), and bead-based techniques (e.g., as described in PCT US/93/04145). Methods of producing protein-based arrays are described in, for example, De Wildt et al. [Nature Biotech. 18:89-994, (2000)], Lueking et al. [Anal. Biochem. 270:103-111, (1999)], Ge [Nucleic Acids Res. 28:e3, I-VII, (2000)], MacBeath and Schreiber [Science 289: 1760-1763, (2000)], and WO 99/51773A1. Addresses in addition to the address of the plurality can be disposed on the array.

The arrays described above can be used to analyze the expression of any of the biomolecular sequences of the present invention. For example, one can contact an array with a sample and detect binding between a component of the sample and a component of the array. In the event nucleic acids are analyzed, one can amplify the nucleic acids obtained from a sample prior to their application to the array. The array can also be used to examine tissue-specific gene expression. For example, the nucleic acids or proteins of the invention (all or a subset thereof) can be distributed on an array that is then exposed to nucleic acids or proteins obtained from a particular tissue, tumor, or cell type. If a sufficient number of diverse samples are analyzed, clustering (e.g., hierarchical clustering, k-means clustering, Bayesian clustering and the like) can be used to identify other genes that are co-regulated with those of the invention. The array can be used not only to determine tissue specific expression, but also to ascertain the level of expression of a battery of genes.

Array analysis of the nucleic acids or proteins of the invention can be used to study the effect of cell-cell interactions or therapeutic agents on the expression of those nucleic acids or proteins. For example, nucleic acid or protein that has been obtained from a cell that has been placed in the vicinity of a tissue that has been perturbed in some way can be obtained and exposed to the probes of an array. Thus, one can use the methods of the invention to determine the effect of one cell type on another (i.e., the response (e.g., a change in the type or quantity of nucleic acids or proteins expressed) to a biological stimulus can be determined). Similarly, nucleic acid or protein that has been obtained from a cell that has been treated with an agent can be obtained and exposed to the probes of an array. In this scenario, one can determine how the therapeutic agent affects the expression of any of the biomolecular sequences of the present invention. Appropriate controls (e.g., assays using cells that have not received a biological stimulus or a potentially therapeutic treatment) can be performed in parallel. Moreover, desirable and undesirable responses can be detected. If an event (e.g., exposure to a biological stimulus or therapeutic compound) has an undesirable effect on a cell, one can either avoid the event (by, e.g., prescribing an alternative therapy) or take steps to counteract or neutralize it.

In more straightforward assays, the arrays described here can be used to monitor the expression of one or more of the biomolecular sequences of the present invention, with respect to time. Such analyses allow one to characterize a disease process associated with the examined sequence.

The arrays are also useful for ascertaining the effect of the expression of a gene on the expression of other genes in the same cell or in different cells (e.g., ascertaining the effect of the expression of any one of the biomolecular sequences of the present invention on the expression of other genes). If altering the expression of one gene has a deleterious effect on the cell (due to its effect on the expression of other genes) one can, again, avoid that effect (by, e.g., selecting an alternate molecular target or counteracting or neutralizing the effect).

Markers

The molecules of the present invention are also useful as markers of: (i) a cell or tissue type; (ii) disease; (iii) a pre-disease state; (iv) drug activity, and (v) predisposition for disease.

Using the methods described herein, the presence or amount of the biomolecular sequences of the present invention, can be detected and correlated with one or more biological states (e.g., a disease state or a developmental state). When used in this way, the compositions of the invention serve as surrogate markers; they provide an objective indicia of the presence or extent of a disease (e.g., cancer). Surrogate markers are particularly useful when a disease is difficult to assess with standard methods (e.g., when a subject has a small tumor or when pre-cancerous cells are present). It follows that surrogate markers can be used to assess a disease before a potentially dangerous clinical endpoint is reached. Other examples of surrogate markers are known in the art (see, e.g., Koomen et al., J. Mass Spectrom. 35:258-264, 2000, and James, AIDS Treatment News Archive 209, 1994).

The biomolecular sequences of the present invention, can also serve as pharmacodynamic markers, which provide an indicia of a therapeutic result. As pharmacodynamic markers are not directly related to the disease for which the drug is being administered, their presence (or levels of expression) indicates the presence or activity of a drug in a subject (i.e., the pharmacodynamic marker may indicate the concentration of a drug in a biological tissue, as the gene or protein serving as the marker is either expressed or transcribed (or not) in the body in relationship to the level or activity of the drug). One can also monitor the distribution of a drug with a pharmacodynamic marker (e.g., these markers can be used to determine whether a drug is taken up by a particular cell type). The presence or amount of pharmacodynamic markers can be related to the drug per se or to a metabolite produced from the drug. Thus, these markers can indicate the rate at which a drug is broken down in vivo. Pharmacodynamic markers can be particularly sensitive (e.g., even a small amount of a drug may activate substantial transcription or translation of a marker), and they are therefore useful in assessing drugs that are administered at low doses. Examples regarding the use of pharmacodynamic markers are known in the art and include: U.S. Pat. No. 6,033,862; Hattis et al. Env. Health Perspect. 90: 229-238, (1991); Schentag, Am. J. Health-Syst. Pharm. 56 Suppl. 3:S21-S24, (1999); and Nicolau, Am. J. Health-Syst. Pharm. 56 Suppl. 3:S16-S20, (1991).

The biomolecular sequences of the present invention, are also useful as pharmacogenomic markers, which can provide an objective correlate to a specific clinical drug response or susceptibility in a particular subject or class of subjects [see, e.g., McLeod et al., Eur. J. Cancer 35:1650-1652, (1999)]. The presence or amount of the pharmacogenomic marker is related to the predicted response of a subject to a specific drug (or type of drug) prior to administration of the drug. By assessing one or more pharmacogenomic markers in a subject, the drug therapy that is most appropriate for the subject, or which is predicted to have a greater likelihood of success, can be selected. For example, based on the presence or amount of RNA or protein associated with a specific tumor marker in a subject, an optimal drug or treatment regime can be prescribed for the subject.

More generally, pharmacogenomics addresses the relationship between an individual's genotype and that individual's response to a foreign compound or drug. Differences in the way individual subjects metabolize therapeutics can lead to severe toxicity or therapeutic failure because metabolism alters the relation between dose and blood concentration of the pharmacologically active drug. Thus, a physician would consider the results of pharmacogenomic studies when determining whether to administer a composition of the present invention and how to tailor a therapeutic regimen for the subject.

Pharmacogenomics deals with clinically significant hereditary variations in the response to drugs due to altered drug disposition and abnormal action in affected persons. See, e.g., Eichelbaum et al., Clin. Exp. Pharmacol. Physiol. 23:983-985, (1996), and Linder et al., Clin. Chem. 43:254-266, (1997). In general, two types of pharmacogenetic conditions can be differentiated. Genetic conditions transmitted as a single factor can: (i) alter the way drugs act on the body (altered drug action) or (ii) the way the body acts on drugs (altered drug metabolism). These pharmacogenetic conditions can occur either as rare genetic defects or as naturally-occurring polymorphisms.

One approach that can be used to identify genes that predict drug response, known as "a genome-wide association," relies primarily on a high-resolution map of the human genome consisting of already known gene-related markers (e.g., a "bi-allelic" gene marker map that consists of 60,000-100,000 polymorphic or variable sites on the human genome, each of which has two variants.) Such a high-resolution genetic map can be compared to a map of the genome of each of a statistically significant number of patients taking part in a Phase II/III drug trial to identify markers associated with a particular observed drug response or side effect. Alternatively, a high resolution map can be generated from a combination of some ten-million known single nucleotide polymorphisms (SNPs; a common alteration that occurs in a single nucleotide base in a stretch of DNA) in the human genome. For example, a SNP may occur once per every 1000 bases of DNA. While a SNP may be involved in a disease process, the vast majority may not be disease-associated. Given a genetic map based on the occurrence of such SNPs, individuals can be grouped into genetic categories depending on a particular pattern of SNPs in their individual genome. In such a manner, treatment regimens can be tailored to groups of genetically similar individuals, taking into account traits that may be common among such genetically similar individuals.

Two alternative methods, the "candidate gene approach" and "gene expression profiling," can be used to identify pharmacogenomic markers. According to the first method, if a gene that encodes a drug's target is known, all common variants of that gene can be fairly easily identified in the population, and one can determine whether having one version of the gene versus another is associated with a particular drug response. In the second approach, the gene expression of an animal dosed with a drug (e.g., a composition of the invention) can reveal whether gene pathways related to toxicity have been activated.

Information generated using one or more of the approaches described above can be used in designing therapeutic or prophylactic treatments that are less likely to fail or to produce adverse side effects when a subject is treated with a therapeutic composition.

Informatics

The biomolecular sequences of the present invention can be provided in a variety of media to facilitate their use. For example, one or more of the sequences (e.g., subsets of the sequences expressed in a defined tissue type) can be provided as a manufacture (e.g., a computer-readable storage medium such as a magnetic, optical, optico-magnetic, chemical or mechanical information storage device). The manufacture can provide a nucleic acid or amino acid sequence in a form that will allow examination of the manufacture in ways that are not applicable to a sequence that exists in nature or in purified form. The sequence information can include full-length sequences, fragments thereof, polymorphic sequences including single nucleotide polymorphisms (SNPs), epitope sequence, and the like.

The computer readable storage medium further includes sequence annotations (as described in Example 10 of the Examples section).

The computer readable storage medium can further include information pertaining to generation of the data and/or potential uses thereof.

As used herein, a "computer-readable medium" refers to any medium that can be read and accessed directly by a machine [e.g., a digital or analog computer; e.g., a desktop PC, laptop, mainframe, server (e.g., a web server, network server, or server farm), a handheld digital assistant, pager, mobile telephone, or the like]. Computer-readable media include: magnetic storage media, such as floppy discs, hard disc storage medium, and magnetic tape; optical storage media such as CD-ROM; electrical storage media such as RAM, ROM, EPROM, EEPROM, flash memory, and the like; and hybrids of these categories such as magnetic/optical storage media.

A variety of data storage structures are available to those of ordinary skill in the art and can be used to create a computer-readable medium that has recorded one or more (or all) of the nucleic acids and/or amino acid sequences of the present invention. The data storage structure will generally depend on the means chosen to access the stored information. In addition, a variety of data processor programs and formats can be used to store the sequence information of the present invention on machine or computer-readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. One of ordinary skill in the art can readily adapt any number of data processor structuring formats (e.g., text file or database) to obtain machine or computer-readable medium having recorded thereon the sequence information of the present invention.

The sequence information and annotations are stored in a relational database (such as Sybase or Oracle) that can have a first table for storing sequence (nucleic acid and/or amino acid sequence) information. The sequence information can be stored in one field (e.g., a first column) of a table row and an identifier for the sequence can be stored in another field (e.g., a second column) of the table row. The database can have a second table (to, for example, store annotations). The second table can have a field for the sequence identifier, a field for a descriptor or annotation text (e.g., the descriptor can refer to a functionality of the sequence), a field for the initial position in the sequence to which the annotation refers, and a field for the ultimate position in the sequence to which the annotation refers. Examples for annotation to nucleic acid sequences and amino acid sequences are provided in Examples 10 and 14-20 of the Examples section.

Pharmaceutical Compositions

The nucleic acids, fragments thereof, hybrid sequences of which they are a part, and gene constructs containing them; proteins, fragments thereof, chimeras, and antibodies that specifically bind thereto; and cells, including those that are engineered to express the nucleic acids or proteins of the invention) can be incorporated into pharmaceutical compositions. These compositions typically also include a solvent, a dispersion medium, a coating, an antimicrobial (e.g., an antibacterial or antifungal) agent, an absorption delaying agent (when desired, such as aluminum monostearate and gelatin), or the like, compatible with pharmaceutical administration (see below). Active compounds, in addition to those of the present invention, can also be included in the composition and may enhance or supplement the activity of the present agents.

The composition will be formulated in accordance with their intended route of administration. Acceptable routes include oral or parenteral routes (e.g., intravenous, intradermal, transdermal (e.g., subcutaneous or topical), or transmucosal (i.e., across a membrane that lines the respiratory or anogenital tract). The compositions can be formulated as a solution or suspension and, thus, can include a sterile diluent (e.g., water, saline solution, a fixed oil, polyethylene glycol, glycerine, propylene glycol or another synthetic solvent); an antimicrobial agent (e.g., benzyl alcohol or methyl parabens; chlorobutanol, phenol, ascorbic acid, thimerosal, and the like); an antioxidant (e.g., ascorbic acid or sodium bisulfite); a chelating agent (e.g., ethylenediaminetetraacetic acid); or a buffer (e.g., an acetate-, citrate-, or phosphate-based buffer). When necessary, the pH of the solution or suspension can be adjusted with an acid (e.g., hydrochloric acid) or a base (e.g., sodium hydroxide). Proper fluidity (which can ease passage through a needle) can be maintained by a coating such as lecithin, by maintaining the required particle size (in the case of a dispersion), or by the use of surfactants.

The compositions of the invention can be prepared as sterile powders (by, e.g., vacuum drying or freeze-drying), which can contain the active ingredient plus any additional desired ingredient from a previously sterile-filtered solution.

Oral compositions generally include an inert diluent or an edible carrier. For example, the active compound can be incorporated with excipients and used in the form of tablets, troches, or capsules (e.g., gelatin capsules). Oral compositions can be prepared using fluid carries and used as mouthwashes. The tablets etc. can also contain a binder (e.g., microcrystalline cellulose, gum tragacanth, or gelatin); an excipient (e.g., starch or lactose), a disintegrating agent (e.g., alginic acid, Primogel, or corn starch); a lubricant (e.g., magnesium stearate or Sterotes); a glidant (e.g., colloidal silicon dioxide); a sweetening agent (e.g., sucrose or saccharine); or a flavoring agent (e.g., peppermint, methyl salicylate, or orange flavoring.

For administration by way of the respiratory system, the compositions can be formulated as aerosol sprays (e.g., from a pressured container or dispenser that contains a suitable propellant (e.g., a gas such as carbon dioxide), or a nebulizer. The ability of a composition to cross a biological barrier can be enhanced by agents known in the art. For example, detergents, bile salts, and fusidic acid derivatives can facilitate transport across the mucosa (and therefore, be included in nasal sprays or suppositories).

For topical administration, the active compounds are formulated into ointments, salves, gels, or creams according to methods known in the art.

Controlled release can also be achieved by using implants and microencapsulated delivery systems (see, e.g., the materials commercially available from Alza Corporation and Nova Pharmaceuticals, Inc.; see also U.S. Pat. No. 4,522,811 for the use of liposome-based suspensions).

The pharmaceutical compositions of the invention can be formulated in dosage units (i.e., physically discrete units containing a predetermined quantity of the active compound) for uniformity and ease of administration.

The toxicity and therapeutic efficacy of any given compound can be determined by standard pharmaceutical procedures carried out in cell culture or in experimental animals. For example, one of ordinary skill in the art can routinely determine the LD50 (the dose lethal to 50% of the population) and the ED50 (the dose therapeutically effective in 50% of the population). The dose ratio between toxic and therapeutic effects is the therapeutic index. Compounds that exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies described hereinabove can be used to formulate a range of dosage for use in humans (preferably a dosage within a range of circulating concentrations that include the ED50 with little or no toxicity). The dosage may vary within this range depending upon the formulation and the route of administration. For any compound used in the method of the invention, the therapeutically effective dose can be estimated initially from cell culture assays. A dose may be formulated in animal models to achieve a circulating plasma concentration range that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

A therapeutically effective amount of a protein of the present invention can range from about 0.001 to 30 mg/kg body weight (e.g., about 0.01 to 25 mg/kg, about 0.1 to 20 mg/kg, or about 1 to 10 (e.g., 2-9, 3-8, 4-7, or 5-6) mg/kg). The protein can be administered one time per week for between about 1 to 10 weeks (e.g., 2 to 8 weeks, 3 to 7 weeks, or about 4, 5, or 6 weeks). However, a single administration can also be efficacious. Certain factors can influence the dosage and timing required to effectively treat a subject. These factors include the severity of the disease, previous treatments, and the general health or age of the subject.

When the active ingredient is an antibody, the dosage can be about 0.1 mg/kg of body weight (generally 10-20 mg/kg). If the antibody is to act in the brain, a dosage of 50 mg/kg to 100 mg/kg is usually appropriate. Generally, partially human antibodies and fully human antibodies have a longer half-life within the human body than other antibodies. Accordingly, lower dosages and less frequent administration are often possible with these types of antibodies. Modifications such as lipidation can be used to stabilize antibodies and to enhance uptake and tissue penetration [e.g., into the brain; see Cruikshank et al., J. Acquired Immune Deficiency Syndromes and Human Retrovirology 14:193, (1997)].

As noted above, the present invention encompasses agents (e.g., small molecules) that modulate expression or activity of a nucleic acid represented by any of biomolecular sequences of the present invention. Exemplary doses of these agents include milligram or microgram amounts of the small molecule per kilogram of subject or sample weight (e.g., about 1-500 mg/kg; about 100 mg/kg; about 5 mg/kg; about 1 mg/kg; or about 50 μg/kg). Appropriate doses of a small molecule depend upon the potency of the small molecule with respect to the expression or activity to be modulated. When one or more of these small molecules is to be administered to an animal (e.g., a human) to modulate expression or activity of nucleic acid or protein of the invention, a physician, veterinarian, or researcher may prescribe a relatively low dose at first, subsequently increasing the dose until an appropriate response is obtained. In addition, it is understood that the specific dose level for any particular animal subject will depend upon a variety of factors including the activity of the specific compound employed, the age, body weight, general health, gender, and diet of the subject, the time of administration, the route of administration, the rate of excretion, any drug combination, and the degree of expression or activity to be modulated.

Pharmaceutical compositions of the present invention may also include a therapeutic moiety such as a cytotoxin (i.e., an agent that is detrimental to a cell), a therapeutic agent, or a radioactive ion can be conjugated to the biomolecular sequences of the present invention or related compositions, described hereinabove (e.g., antibodies, antisense molecules, ribozymes etc.). The cytotoxin can be, for example, taxol, cytochalasin B, gramicidin D, ethidium bromide, emetine, mitomycin, etoposide, tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, puromycin, maytansinoids (e.g., maytansinol; see U.S. Pat. No. 5,208,020), CC-1065 (see U.S. Pat. Nos. 5,475,092, 5,585,499, and 5,846,545) and analogs or homologs thereof. Therapeutic agents include antimetabolites (e.g., methotrexate, 6-mercaptopurine, 6-thioguanine, cytarabine, 5-fluorouracil decarbazine), alkylating agents (e.g., mechlorethamine, thioepa chlorambucil, CC-1065, melphalan, carmustine (BSNU) and lomustine (CCNU), cyclothosphamide, busulfan, dibromomannitol, streptozotocin, mitomycin C, and cis-dichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine, vinblastine, taxol and maytansinoids). Radioactive ions include, but are not limited to iodine, yttrium and praseodymium.

Other therapeutic moieties include, but are not limited to, toxins such as abrin, ricin A, pseudomonas exotoxin, or diphtheria toxin; a protein such as tumor necrosis factor, γ-interferon, β-interferon, nerve growth factor, platelet derived growth factor, tissue plasminogen activator; or, biological response modifiers such as, for example, lymphokines, interleukin-1 (IL-1), interleukin-2 (IL-2), interleukin-6 (IL-6), granulocyte macrophase colony stimulating factor (GM-CSF), granulocyte colony stimulating factor (G-CSF), or other growth factors.

The nucleic acid molecules of the invention can be inserted into vectors and used as gene therapy vectors. Gene therapy vectors can be delivered to a subject by, for example, intravenous injection, local administration (see U.S. Pat. No. 5,328,470) or by stereotactic injection (see e.g., Chen et al., Proc. Natl. Acad. Sci. USA 91:3054-3057, 1994). The pharmaceutical preparation of the gene therapy vector can include the gene therapy vector in an acceptable diluent, or can comprise a slow release matrix in which the gene delivery vehicle is imbedded. Alternatively, where the complete gene delivery vector can be produced intact from recombinant cells (e.g. retroviral vectors), the pharmaceutical preparation can include one or more cells which produce the gene delivery system. The pharmaceutical compositions of the invention can be included in a container, pack, or dispenser together with instructions for administration.

Methods of Treatment

The present invention provides for both prophylactic and therapeutic methods of treating a subject at risk of (or susceptible to) a disorder or having a disorder associated with aberrant or unwanted expression or activity of a nucleic acid or protein of the invention. "Treatment" encompasses the application or administration of a therapeutic agent to a patient, or to an isolated tissue or cell line (e.g., one obtained from the patient to be treated), with the purpose of curing or lessening the severity of the disease or a symptom associated with the disease.

Whether carried out prophylactically or therapeutically, the methods of the invention can be specifically tailored or modified, based on knowledge obtained from the field of pharmacogenomics (see above).

Thus, the invention provides a method for preventing in a subject, a disease associated with mis-expression of a nucleic acid or protein of the present invention. Such diseases include cellular proliferative and/or differentiative disorders, disorders associated with bone metabolism, immune disorders, cardiovascular disorders, liver disorders, viral diseases, pain or metabolic disorders.

Examples of cellular proliferative and/or differentiative disorders include cancer (e.g., carcinoma, sarcoma, metastatic disorders or hematopoietic neoplastic disorders such as leukemias and lymphomas). A metastatic tumor can arise from a multitude of primary tumor types, including but not limited to those of prostate, colon, lung, breast or liver.

The terms "cancer," "hyperproliferative," and "neoplastic," are used in reference to cells that have exhibited a capacity for autonomous growth (i.e., an abnormal state or condition characterized by rapid cellular proliferation). Hyperproliferative and neoplastic disease states can be categorized as pathologic (i.e., characterizing or constituting a disease state), or can be categorized as non-pathologic (i.e., deviating from normal but not associated with a disease state). The term is meant to include all types of cancerous growths or oncogenic processes, metastatic tissues or malignantly transformed cells, tissues, or organs, irrespective of histopathologic type or stage of invasiveness. "Pathologic hyperproliferative" cells occur in disease states characterized by malignant tumor growth. Examples of non-pathologic hyperproliferative cells include proliferation of cells associated with wound repair.

The terms "cancer" or "neoplasms" include malignancies of the various organ systems, such as affecting lung, breast, thyroid, lymphoid, gastrointestinal, and genito-urinary tract, as well as adenocarcinomas, which include malignancies such as most colon cancers, renal-cell carcinoma, prostate cancer and/or testicular tumors, non-small cell carcinoma of the lung, cancer of the small intestine and cancer of the esophagus.

The term "carcinoma" refers to malignancies of epithelial or endocrine tissues including respiratory system carcinomas, gastrointestinal system carcinomas, genitourinary system carcinomas, testicular carcinomas, breast carcinomas, prostatic carcinomas, endocrine system carcinomas, and melanomas. Exemplary carcinomas include those forming from tissue of the cervix, lung, prostate, breast, head and neck, colon and ovary. The term also includes carcinosarcomas (e.g., which include malignant tumors composed of carcinomatous and sarcomatous tissues). An "adenocarcinoma" refers to a carcinoma derived from glandular tissue or in which the tumor cells form recognizable glandular structures. The term "sarcoma" is art recognized and refers to malignant tumors of mesenchymal derivation. As used herein, the term "hematopoietic neoplastic disorder(s)" includes diseases involving hyperplastic/neoplastic cells of hematopoietic origin. A hematopoietic neoplastic disorder can arise from myeloid, lymphoid or erythroid lineages, or precursor cells thereof. Preferably, the diseases arise from poorly differentiated acute leukemias (e.g., erythroblastic leukemia and acute megakaryoblastic leukemia). Additional exemplary myeloid disorders include, but are not limited to, acute promyeloid leukemia (APML), acute myelogenous leukemia (AML) and chronic myelogenous leukemia (CML) (see Vaickus, Crit Rev. in Oncol./Hemotol. 11:267-97, 1991); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include, but are not limited to non-Hodgkin lymphoma and variants thereof, peripheral T cell lymphomas, adult T cell leukemia/lymphoma (ATL), cutaneous T-cell lymphoma (CTCL), large granular lymphocytic leukemia (LGF), Hodgkin's disease and Reed-Sternberg disease.

The leukemias, including B-lymphoid leukemias, T-lymphoid leukemias, undifferentiated leukemias, erythroleukemia, megakaryoblastic leukemia, and monocytic leukemias are encompassed with and without differentiation; chronic and acute lymphoblastic leukemia, chronic and acute lymphocytic leukemia, chronic and acute myelogenous leukemia, lymphoma, myelo dysplastic syndrome, chronic and acute myeloid leukemia, myelomonocytic leukemia; chronic and acute myeloblastic leukemia, chronic and acute myelogenous leukemia, chronic and acute promyelocytic leukemia, chronic and acute myelocytic leukemia, hematologic malignancies of monocyte-macrophage lineage, such as juvenile chronic myelogenous leukemia; secondary AML, antecedent hematological disorder; refractory anemia; aplastic anemia; reactive cutaneous angioendotheliomatosis; fibrosing disorders involving altered expression in dendritic cells, disorders including systemic sclerosis, E-M syndrome, epidemic toxic oil syndrome, eosinophilic fasciitis localized forms of scleroderma, keloid, and fibrosing colonopathy; angiomatoid malignant fibrous histiocytoma; carcinoma, including primary head and neck squamous cell carcinoma; sarcoma, including kaposi's sarcoma; fibroadanoma and phyllodes tumors, including mammary fibroadenoma; stromal tumors; phyllodes tumors, including histiocytoma; erythroblastosis; and neurofibromatosis.

Examples of disorders involving the heart or "cardiovascular disorders" include, but are not limited to, a disease, disorder, or state involving the cardiovascular system, e.g., the heart, the blood vessels, and/or the blood. A cardiovascular disorder can be caused by an imbalance in arterial pressure, a malfunction of the heart, or an occlusion of a blood vessel, e.g., by a thrombus. Examples of such disorders include hypertension, atherosclerosis, coronary artery spasm, congestive heart failure, coronary artery disease, valvular disease, arrhythmias, and cardiomyopathies.

As discussed, diseases associated (e.g., causally associated) with over expression of a nucleic acid of the invention (as determined, for example, by the in vivo or ex vivo analyses described above), can be treated with techniques in which one inhibits the expression or activity of the nucleic acid or its gene products. For example, a compound (e.g., an agent identified using an assay described above) that exhibits negative modulatory activity with respect to a nucleic acid of the invention (the expression or over expression of which is causally associated with a disease) can be used to prevent and/or ameliorate that disease or one or more of the symptoms associated with it. The compound can be a peptide, phosphopeptide, small organic or inorganic molecule, or antibody (e.g., a polyclonal, monoclonal, humanized, anti-idiotypic, chimeric or single chain antibodies, and Fab, F(ab')2 and Fab expression library fragments, scFV molecules, and epitope-binding fragments thereof).

Further, antisense, ribozyme, and triple-helix molecules (see above) that inhibit expression of the target gene (e.g., a gene of the invention) can also be used to reduce the level of target gene expression, thus effectively reducing the level of target gene activity. If necessary, to achieve a desirable level of gene expression, molecules that inhibit gene expression can be administered with nucleic acid molecules that encode and express target gene polypeptides exhibiting normal target gene activity. Of course, where the assays of the invention indicate that expression or over expression is desirable, the nucleic acid can be introduced into cells via gene therapy methods with little or no treatment with inhibitory agents (this can be done to combat not only under expression, but over secretion of a gene product).

Aptamer molecules (nucleic acid molecules having a tertiary structure that permits them to specifically bind to protein ligands; [see, e.g., Osborne et al., Curr. Opin. Chem. Biol. 1: 5-9, (1997) and Patel Curr. Opin. Chem. Biol. 1:32-46, (1997)] are also useful therapeutics. Since nucleic acid molecules can usually be more conveniently introduced into target cells than therapeutic proteins may be, aptamers offer a method by which protein activity can be specifically decreased without the introduction of drugs or other molecules that may have pluripotent effects.

As noted above, the nucleic acids of the invention and the proteins they encode can be used as immunotherapeutic agents (to, e.g., elicit an immune response against a protein of interest). However, in some circumstances, undesirable effects occur when a subject is injected with a protein or an epitope that stimulate antibody production. In those circumstances, one can instead generate an immune response with an anti-idiotypic antibody [see, e.g., Herlyn, Ann. Med. 31:66-78, 1991 and Bhattacharya-Chatterjee and Foon, Cancer Treat. Res. 94:51-68, (1998)]. Effective anti-idiotypic antibodies stimulate the production of anti-anti-idiotypic antibodies, which specifically bind the protein in question. Vaccines directed to a disease characterized by expression of the nucleic acids of the present invention can also be generated in this fashion. In other circumstances, the target antigen is intracellular. In these circumstances, antibodies (including fragments, single chain antibodies, or other types of antibodies described above) can be internalized within a cell by delivering them with, for example, a lipid-based delivery system (e.g., Lipofectin™ or liposomes). Single chain antibodies can also be administered by delivering nucleotide sequences that encode them to the target cell population (see, e.g., Marasco et al., Proc. Natl. Acad. Sci. USA 90:7889-7893, 1993).

Additional objects, advantages, and novel features of the present invention will become apparent to one ordinarily skilled in the art upon examination of the following examples, which are not intended to be limiting. Additionally, each of the various embodiments and aspects of the present invention as delineated hereinabove and as claimed in the claims section below finds experimental support in the following examples.

EXAMPLES

Reference is now made to the following examples, which together with the above descriptions, illustrate the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, N.Y. (1988); Watson et al., "Recombinant DNA", Scientific American Books, New York; Birren et al. (eds) "Genome Analysis: A Laboratory Manual Series", Vols. 1-4, Cold Spring Harbor Laboratory Press, N.Y. (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., N.Y. (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example 1

Identification of Alternatively Spliced Expressed Sequences Background

The etiology of many kinds of cancers, especially those involving multiple genes or sporadic mutations, is yet to be elucidated. Accumulative EST information coming from heterogeneous tissues and cell-types, can be used as a considerable source to understanding some of the events inherent to carcinogenesis.

Although a large number of current bioinformatics tools are used to predict tissue specific genes in general and cancer specific genes in particular, all fail to consider alternatively spliced variants [Boguski and Schuler (1995) Nat. Genet. 10:369-71, Audic and Claverie (1997) Genome Res. 7:986-995; Huminiecki and Bicknell (2000) Genome Res. 10:1796-1806; Kawamoto et al. (2000) Genome Res. 10:1817-1827]. Alternative splicing is also overlooked by wet laboratory methods such as SAGE and microarray experiments which have been widely used to study gene expression, however remain to be linked to alternative splicing modeling [see Background section and Valculescu et al. (1995) Science 270:484-487; Caron et al. (2001) Science 291:1289-1292 and Schena et al. (1995) Science 270:467-470].

A computational-based approach was developed to identify alternatively spliced transcripts, which are expressed in a temporal and/or spatial pattern. Examples 1-4 below describe the identification of cancer specific alternatively spliced isoforms, which were identified according to the teachings of the present invention.

Experimental Procedures and Reagents

DATA and LEADS alternative splicing modeling—GenBank version 125 with genomic build #25 from National Center for Biotechnology Information (NCBI) was used as an input to the LEADS platform as described [Shoshan et al. (2001) Proc. SPIE Microarrays: Optical Technologies and Informatics 4266:86-95; Matloubian (2000) Nat. Immunol. 1:298-304; David et al. (2002) J. Biol. Chem. 277:18084-18090; Sorek et al. (2002) Genome Res. 12:1060-7]. UniGene Build #146 and libraryQuest.txt were obtained from NCBI and Cancer Genome Anatomy Project (CGAP) in National Cancer Institute (NCI), respectively.

EST tissue information—EST information was available in web form from Library Browser or Library Finder in NCBI or in the flat file libraryQuest.txt. The file listed 53 tissue sources, 5 histological states (cancer, multiple histology, normal, pre-cancer, and uncharacterized histology), 6 types of tissue preparations (bulk, cell line, flow-sorted, microdissected, multiple preparation, and uncharacterized), and brief descriptions on each library. 5318 libraries were from bulk tissue preparation {including 5000 ORESTES libraries [Camargo et al. (2001) Proc. Natl. Acad. Sci. USA 98:12103-12108]}, 329 from cell lines, 37 flow-sorted, 66 microdissected, 5 multiple preparation, and 1121 were from uncharacterized preparations. Excluding ORESTES libraries, 507 libraries were designated as 'non-normalized' and 100 were designated 'normalized' or 'subtracted' indicating the pretreatment of mRNA before cDNA library construction. A small number of libraries were derived from the same original sample. These were not considered separately. Library counts of ESTs rather than direct EST counts were used to provide semi-quantitative measurements of expression level, since EST counts in some cases reflect the prevalence of ESTs in one or a few particular libraries, and library counts provide better indications across different tissue types when both normalized and non-normalized libraries were analyzed. Such tissue information analyses are limited to those tissues with a sufficient number of libraries. The inclusion of normalized cDNA libraries allowed the examination of genes expressed at low levels.

The ESTs from 'pooled tissue' or 'uncharacterized tissue' were considered as non-conforming in order to maintain the robustness of the results. In addition, 139,243 ESTs that had no library information were considered non-conforming in investigating tissue- or cancer-specific alternative splicing events.

Results—Human EST and mRNA sequences aligned against genomic sequences and clustered through Compugen's LEADS platform were used to identify intron boundaries and alternative splicing sites [Shoshan et al. (2001) Proc. SPIE Microarrays: Optical Technologies and Informatics 4266:86-95; Matloubian (2000) Nat. Immunol. 1:298-304; David et al. (2002) J. Biol. Chem. 277:18084-18090; Sorek et al. (2002) Genome Res. 12:1060-7].

20,301 clusters with 2.0 million ESTs contained at least one mRNA sequence, in general agreement with UniGene build #148 with 20,876 such clusters. The remaining EST sequences, which were clustered to unknown regions of known genes or to unknown genes were not analyzed. Table 1 below provides some statistics about EST and mRNA clustering. 125,115 introns, and 213,483 exons were aligned either with an mRNA, or with ESTs from at least two libraries if there was no RNA aligned to the gene segment. This was effected to exclude possible genomic contamination in expressed sequences, or other EST technology associated faults.

TABLE 1

| EST | Cluster | RNA | Cluster |
|---|---|---|---|
| 1 | 963 | 1 | 6527 |
| 2-3 | 1457 | 2-3 | 6372 |
| 4-7 | 1532 | 4-7 | 6204 |
| 8-15 | 1655 | 8-15 | 1915 |
| 16-31 | 1879 | 16-31 | 226 |
| 32-63 | 2500 | 32-63 | 40 |
| 64-127 | 3481 | 64 and above | 17 |
| 128-255 | 3240 | Total | 20301 |
| 256-511 | 1406 | | |
| 512-1023 | 422 | | |
| 1024-above | 1766 | | |
| Total | 20301 | | |

Example 2

Cluster Distribution of Alternatively Spliced Donor and Acceptor Sites

Figure 3:
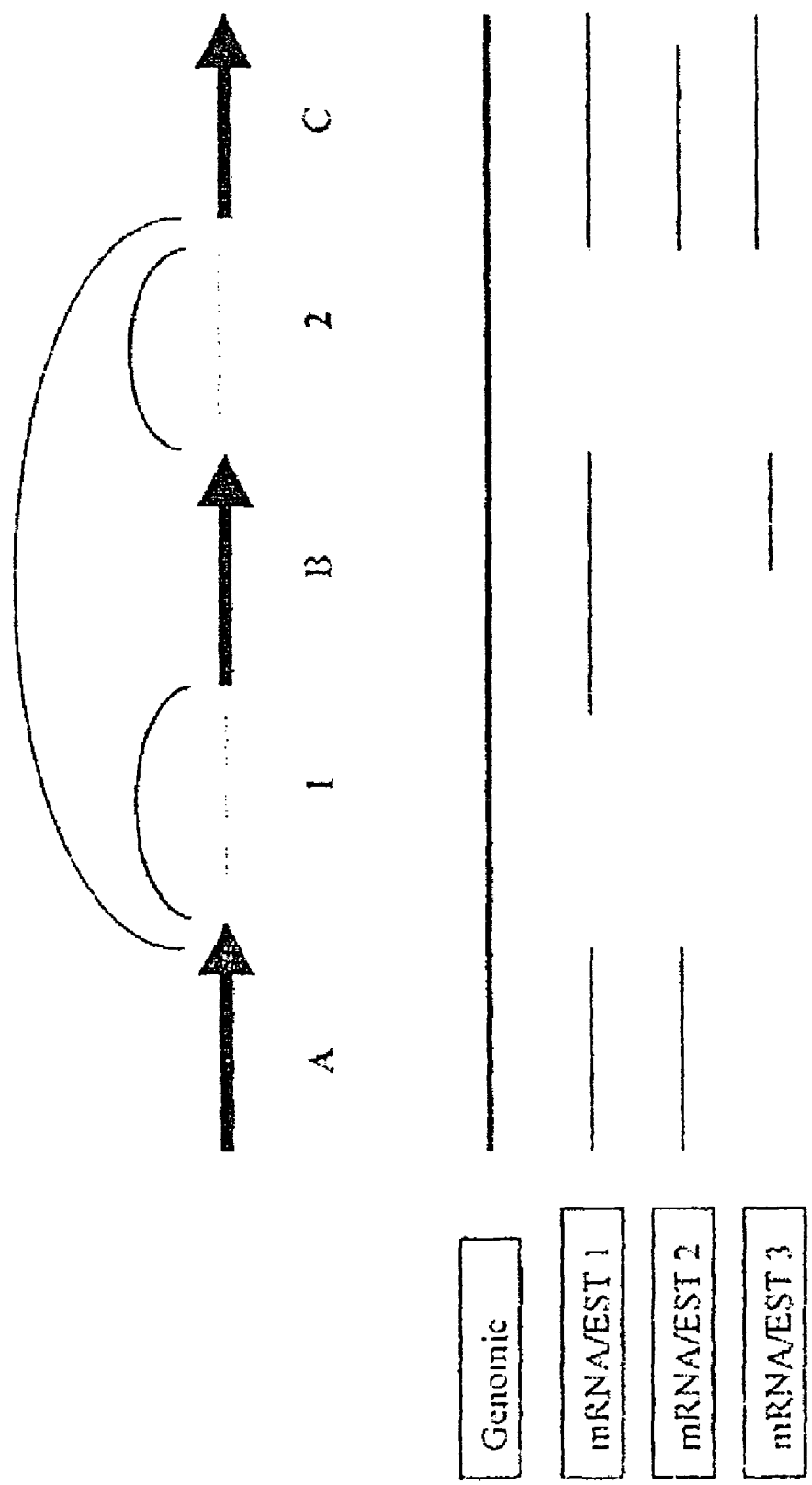
FIG. 3 is a scheme illustrating multiple alignment of alternatively spliced expressed sequences with a genomic sequence including 3 exons (A, B and C) and two introns. Two alternative splicing events are described; One from the donor site, which involves an AB junction, between donor and proximal acceptor and an AC junction, between donor and distal acceptor; A Second alternative splicing event is described from the acceptor site, which involves AC junction, between distal donor and acceptor and BC junction, between proximal donor and acceptor.

Alternative splice events include exon skipping, alternative 5' or 3' splicing, and intron retention, which can be described by the following simplification: a single exon connects to at least two other exons in either the 3'end (donor site) or the 5' end (acceptor site), as shown in FIG. 3. Table 2 below lists some statistics of alternative splicing events based on this simplification.

TABLE 2

| Alternative donor site | Cluster | Alternative acceptor site | Cluster |
|---|---|---|---|
| 1 | 3690 | 1 | 3751 |
| 2 | 2269 | 2 | 2388 |
| 3 | 1348 | 3 | 1511 |
| 4 | 760 | 4 | 799 |
| 5 | 435 | 5 | 508 |
| 6 and above | 566 | 6 and above | 710 |
| Total | 9068 | Total | 9667 |

Distribution analysis—As described hereinabove a valid donor-acceptor concatenation must be supported by at least one mRNA or by ESTs from at least two different libraries. 8254 clusters were found to have both alternatively spliced donor and acceptor sites. When the lower bound on the number of EST libraries supporting each donor-acceptor concatenation was increased to three, 13,402 alternatively spliced donor sites were shown to be included in 6892 clusters and 15,015 alternatively spliced acceptor sites where shown to be included in 7570 clusters, while 6111 clusters comprised both alternatively spliced donor and acceptor sites.

Example 3

Tissue Distribution of ESTs and Libraries Following LEADS Alternative Splicing Modeling Cluster analysis performed to identify alternatively spliced ESTs (see Example 2) was further used for tissue information extraction. Table 3 below lists ten tissue types with the largest numbers of ESTs along with those from pooled or uncharacterized tissues.

TABLE 3

| | Number of ESTs | | | Number of Libraries | | |
|---|---|---|---|---|---|---|
| Tissue | Normal | Cancer | Total | Normal | Cancer | Total |
| Brain | 93024 | 87803 | 180827 | 30 | 25 | 55 |
| Lung | 35455 | 85596 | 121051 | 92 | 156 | 248 |
| Placenta | 86571 | 27291 | 113862 | 259 | 3 | 262 |
| Uterus | 30052 | 71521 | 101573 | 99 | 107 | 206 |
| Colon | 23796 | 74998 | 98794 | 274 | 445 | 719 |
| Kidney | 42628 | 46811 | 89439 | 9 | 54 | 63 |
| Skin | 32436 | 43085 | 75521 | 8 | 10 | 18 |
| Prostate | 40312 | 27963 | 68275 | 131 | 135 | 266 |
| Mammary gland | 26509 | 36638 | 63147 | 305 | 665 | 970 |
| Head and neck | 12354 | 50167 | 62521 | 62 | 800 | 862 |
| Pooled | 178618 | 992 | 179610 | 15 | 1 | 16 |
| Uncharacterized | 76193 | 9721 | 85914 | 778 | 106 | 884 |

Evidently, ESTs derived from lung, uterus, colon, kidney, mammary gland, head and neck were obtained aminly from cancerous libraries. The distribution of ESTs in normal and cancer libraries in each case was taken into a consideration and used as a parameter for scoring the differential expression annotation.

Example 4

Identification of Putative Cancer Specific Alternatively Spliced Transcripts

Alternative splicing events restricted to cancer tissues were identified by looking for any donor-acceptor concatenations exclusively supported by ESTs from cancer tissues. Table 4 below lists six examples for such. An interesting example is the NONO gene (GenBank Accession No: BC003129), represented by 1496 ESTs. The NONO gene has been previously suggested to code for a possible splicing factor [Dong B, Horowitz D S, Kobayashi R, Krainer A R. Nucleic Acids Res (1993) 25; 21 (17):4085-92]. It's newly discovered restricted expression to cancer tissues suggests that alternative splicing of multiple genes may be regulated during carcinogenesis.

gene_association.pombase (version 1.2, Jul. 22, 2000), ec2go (version 1.2, Oct. 23, 2000), and swp2go (version 1.4, Nov. 15, 2000). 58118 SWISS-Prot proteins have been assigned with at least one GO node by the following sources: 15534 proteins were assigned with at least a functional GO node by conversion of EC (enzyme nomenclature) to GO node. MGI has assigned 5984 SwissProt proteins with GO nodes. 31869 SwissProt proteins were assigned a GO node using SwissProt

TABLE 4

| mRNA/ EST | Uni Gene ID | Pos. | Total E | R | Type | Specific E | R | Non-specific C | N | R | Possible function |
|---|---|---|---|---|---|---|---|---|---|---|---|
| BC003129 | 172207 | 123, 237 | 1496 | 8 | d+ | 15 | 1 | 46 | 20 | 3 | Splicing factor candidate |
| NM_018035 | 279851 | 220, 301 | 584 | 2 | d− | 7 | 0 | 21 | 9 | 2 | No known function |
| AL519365 | 21938 | 474, 513 | 162 | 3 | a− | 8 | 3 | 6 | 1 | 0 | Oxysterol binding |
| BF341144 | 155596 | 507, 542 | 148 | 1 | a+ | 6 | 0 | 7 | 4 | 1 | BCL2/adenovirus E1B interacting |
| AB009357 | 7510 | 1372, 1452 | 205 | 6 | a+ | 7 | 4 | 2 | 4 | 2 | MAPKKK 7 |
| NM_002382 | 42712 | 57, 84 | 165 | 7 | a− | 8 | 1 | 7 | 3 | 6 | MAX protein |

One mRNA/EST containing both splicing junctions identifies the cluster.
'Type' - indicates the type of transcript, which was shown to be cancer specific.
The following symbols were used,
(d) donor site;
(a) acceptor site;
('+') proximal exon;
('−') distal exon.
'Total' - indicates the number of ESTs or mRNAs which were used for analysis.
'Specific/non-specific' - indicates total library number which was used for analysis.
All mRNA sequences under 'specific' were from cancer tissues.
'Position' - identifies splicing boundaries on the sequence.
E—EST;
R—RNA;
C—Cancer;
N—Normal.

Example 5

Ontological Annotation of Proteins—Data Collection

BACKGROUND

Recent progress in genomic sequencing, computational biology and ontology development has presented an opportunity to investigate broad biological systems A gene ontology system was developed and specifically used to annotate human proteins. Examples 5-9 below describe the development of an ontology engine, a computational platform for annotation and resultant annotations of human proteins.

Gene Ontology (GO) and gene association files were obtained from the website of the Gene Ontology Consortium. InterPro scan from the website of the European Bioinformatics Institute, and enzyme database from PROTEOME available at the ExPASy-Swiss Institute of Bioinformatics website. The following databases and versions were used, GenBank release 122.0, SwissProt release 39.0, Enzyme database Release 26.0, InterPro database as of Apr. 6, 2001, NCBI LocusLink data as of Mar. 6, 2001, MEDLINE databases as of Apr. 6, 2001, and the following files from Gene Ontology Consortium: gene_association.fb (version 1.26, Feb. 19, 2001), gene_association.mgi (version 1.19, Mar. 1, 2001), gene_association.sgd (version 1.251, Mar. 13, 2001), keyword correspondence and 33048 SwissProt proteins were assigned GO node by InterPro scanning (available at the European Bioinformatics Institute website). The nonredundant protein database was constructed from GenPep file from NCBI, along with proteins collected from the Saccharomyces genome database (SGD) [Dwight et al. (2002) Nucleic Acids Res. 30:69-72] and the Drosophila genome database (Flybase) [The Flybase consortium 2002 Nucleic Acids Res. 30:106-108], with a total number of 670130.

Example 6

Generation of Progressive Sequence Clusters

A two-stage strategy was used to build a detailed homology map between all proteins in the comprehensive protein database (Example 5). In a first stage, all protein pairs with an E score lower than 0.01 using Blastp with default parameters were cataloged. Table 5 lists the distribution of Blastp results.

TABLE 5

| E escore | Percentage |
|---|---|
| $10^{-10}$-$10^{-2}$ | 17.58 |
| $10^{-20}$-$10^{-10}$ | 13.81 |
| $10^{-30}$-$10^{-20}$ | 11.02 |

TABLE 5-continued

| E escore | Percentage |
|---|---|
| $10^{-40}$-$10^{-30}$ | 12.91 |
| $10^{-50}$-$10^{-40}$ | 10.24 |
| $10^{-60}$-$10^{-50}$ | 5.81 |
| $10^{-70}$-$10^{-60}$ | 3.64 |
| $10^{-80}$-$10^{-70}$ | 2.65 |
| $10^{-90}$-$10^{-80}$ | 2.86 |
| $10^{-100}$-$10^{-90}$ | 2.53 |
| $10^{-110}$-$10^{-100}$ | 2.18 |
| $10^{-120}$-$10^{-110}$ | 1.58 |
| $10^{-130}$-$10^{-120}$ | 1.50 |
| $10^{-140}$-$10^{-130}$ | 1.13 |
| $10^{-150}$-$10^{-140}$ | 1.01 |
| $10^{-160}$-$10^{-150}$ | 1.01 |
| $10^{-170}$-$10^{-160}$ | 0.92 |
| $10^{-178}$-$10^{-170}$ | 0.90 |
| 0.00 | 6.72 |

In the second stage, all homologous protein pairs were aligned through Needlman-Wunsch algorithm with a global alignment to obtain the percentage of identical amino acids between the two proteins. BLOSUM62 was used as the substitution matrix. The percentage of identity was defined as the number of amino acids aligned with nonnegative scores divided by the number of amino acids in both aligned and unaligned length of two proteins in the global alignment. Table 6 shows a percent identity distribution of protein pairs following global alignment. Evidently, the majority of protein pairs (i.e., 68.5%) exhibited identity levels in the range of 10-50%.

TABLE 6

| Identity Level | Percentage |
|---|---|
| 0-10% | 5.67 |
| 10-20% | 24.66 |
| 20-30% | 19.94 |
| 30-40% | 10.94 |
| 40-50% | 7.31 |
| 50-60% | 7.09 |
| 60-70% | 7.24 |
| 70-80% | 6.70 |
| 80-90% | 5.98 |
| 90-100% | 4.47 |

Example 7

Text Mining

Correlations between presence of specific MeSH terms, or specific English words in available text information and Gene Ontology assignments in the training data were obtained. The correlations were then used to predict Gene Ontology for unassigned genes.

Method—Non-characters in titles and abstracts, and in definition line of gene records were eliminated and words were stemmed through the Lingua::stem module available at the website of the Comprehensive Perl Archive Network. Due to the standardized and curated nature of MeSH terms, MeSH terms were not parsed or stemmed. The frequency of each word in all the available text information was calculated. Words that occurred at least 5 times over the whole text information space were retained for further studies. This cut-off threshold was used to eliminate rare words, wrong spellings, and sometimes even the base pair sequence present in either the definition lines or abstracts. In addition, an upper limit of word frequency (common words such as 'and', 'gene', 'protein') and a lower limit of word frequency were defined through repeated training process and manual review. The words within the upper and the lower limits were considered as predictive. Since the correlation between the GO nodes and specific words is positive by nature, negative sentences with words such as 'not' and its variants, such as 'unlikely' or 'unresponsive' were excluded from consideration.

Genes with GO annotation from other sources such as GO consortium, InterPro scanning or keyword mappings were used as training data to obtain the correlation between specific words and specific GO nodes.

The following formula was used. $S = \log(P(m,g)/P(m)P(g))$, wherein S is the LOD score for word m-GO g combination, wherein $P(m,g)$ is the frequency of term m and GO node g co-occurrence among all word and GO combinations, $P(m)$ is the frequency of occurrence of term m among all word occurrences, and $P(g)$ is the frequency of occurrence of GO node g among all GO occurrences.

In order to predict GO node for any specific gene which is linked to one to a few dozen words, the sums of LOD scores from all these words for each possible GO were calculated and sorted, and used for further GO annotation. Multiple MeSH terms-GO correlations were tested and were found to be no more informative than the single MeSH term-GO correlation, and therefore they were not used.

Results—Table 7 below, lists general statistics of text information from publicly available sequence databases.

TABLE 7

| | MeSH term | Title | Abstract | Definition line |
|---|---|---|---|---|
| Number of proteins | 110608 | 106190 | 113073 | 516952 |
| Number of articles | 71703 | 77314 | 82654 | n/a |
| Number of unique words* | 40011 | 18175 | 26630 | 25915 |
| Average number of words per article or per definition line | 19.05 | 2.70 | 11.65 | 6.56 |

A predictive probabilistic model was then applied to create possible GO annotations based on the associated text information. Definition lines of sequence records, MeSH term annotations, titles and abstracts from sequence related publications were modeled separately.

Figure 5:
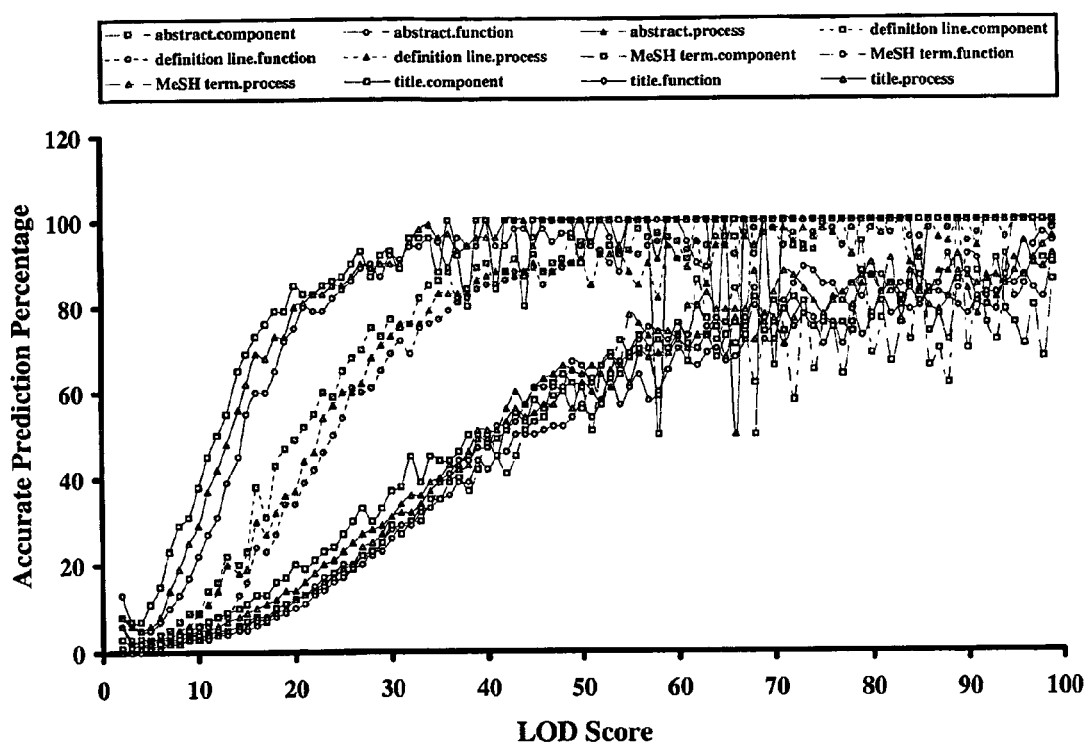
FIG. 5 is a graph illustrating a correlation between LOD scores of textual information analysis and accuracy of ontological annotation prediction. Results are based on self-validation studies. Only predictions made with LOD scores above 2 were evaluated and used for GO annotation process.

The frequency of association of a specific term with a specific GO node in the training data was examined. Parameters such as boundaries of the frequency of MeSH terms and other words were optimized through the training process, using self-validation and cross validation methods. LOD (logarithm of odds) scores, defined as the logarithm of the ratio between the association frequency of any term-GO pair and the calculated frequency of the random combination of this pair, were used to indicate the relatedness of certain terms with certain GO node. These LOD scores were found to be correlative with the accuracy of GO prediction, as shown in FIG. 5. Text information from titles of MEDLINE records appeared to have more predictive power, in particular at lower LOD scores, than text information from other categories. This suggests that the title tended to summarize the gist of an article in a straightforward manner. MeSH terms had similar predictive capabilities as the abstracts, possibly because the MeSH terms were derived from the abstracts, and thus had similar information contents.

Based on text information, a significant number of proteins were predicted to be associated with one or more GO nodes. Table 8 below, lists the number of proteins with predicted GO node from four types of text information in the three categories of GO. These predicted GO annotations were incorporated in GO process to increase the accuracy of homology-based GO annotation and to generate de novo annotations.

TABLE 8

|  | MeSH term | Title | Abstract | Definition Line | Total |
|---|---|---|---|---|---|
| Cellular Component | 57845 | 52094 | 57597 | 514191 | 521396 |
| Molecular Function | 57845 | 54152 | 57632 | 516319 | 523384 |
| Biological Process | 57845 | 53970 | 57631 | 516402 | 523385 |

To further enhance the accuracy and coverage of GO annotation process, a computational platform for predicting cellular localization, ProLoc (Einat Hazkani-Covo, Erez Levanon, Galit Rotman, Dan Graur and Amit Novik, a manuscript submitted for publication), was used to predict the cellular localization of individual proteins based on their inherent features such as specific localization signatures, protein domains, amino acid composition, pI, and protein length. Only protein sequences that begin with methionine underwent ProLoc analysis. Thus, 88997 out of 93110 proteins in SwissProt version 39 were analyzed, and 78111 proteins have one to three GO predictions in cellular component category.

Example 8

Gene Ontology Assignment

Progressive single-linkage clusters with 1% resolution were generated to assign GO annotations (i.e., nodes) to proteins (see Example 6). Protein clustering and annotation assignment were effected at each level of homology. The resolution was 1% for global alignment identity (i.e., clustering was first effected at 98%, then at 97% and so forth). The resolution was 10 fold for the E score of a BlastP homology pair. For example, clustering was performed at $10^{-50}$, then at $10^{-40}$ and so forth.

Figure 6A:
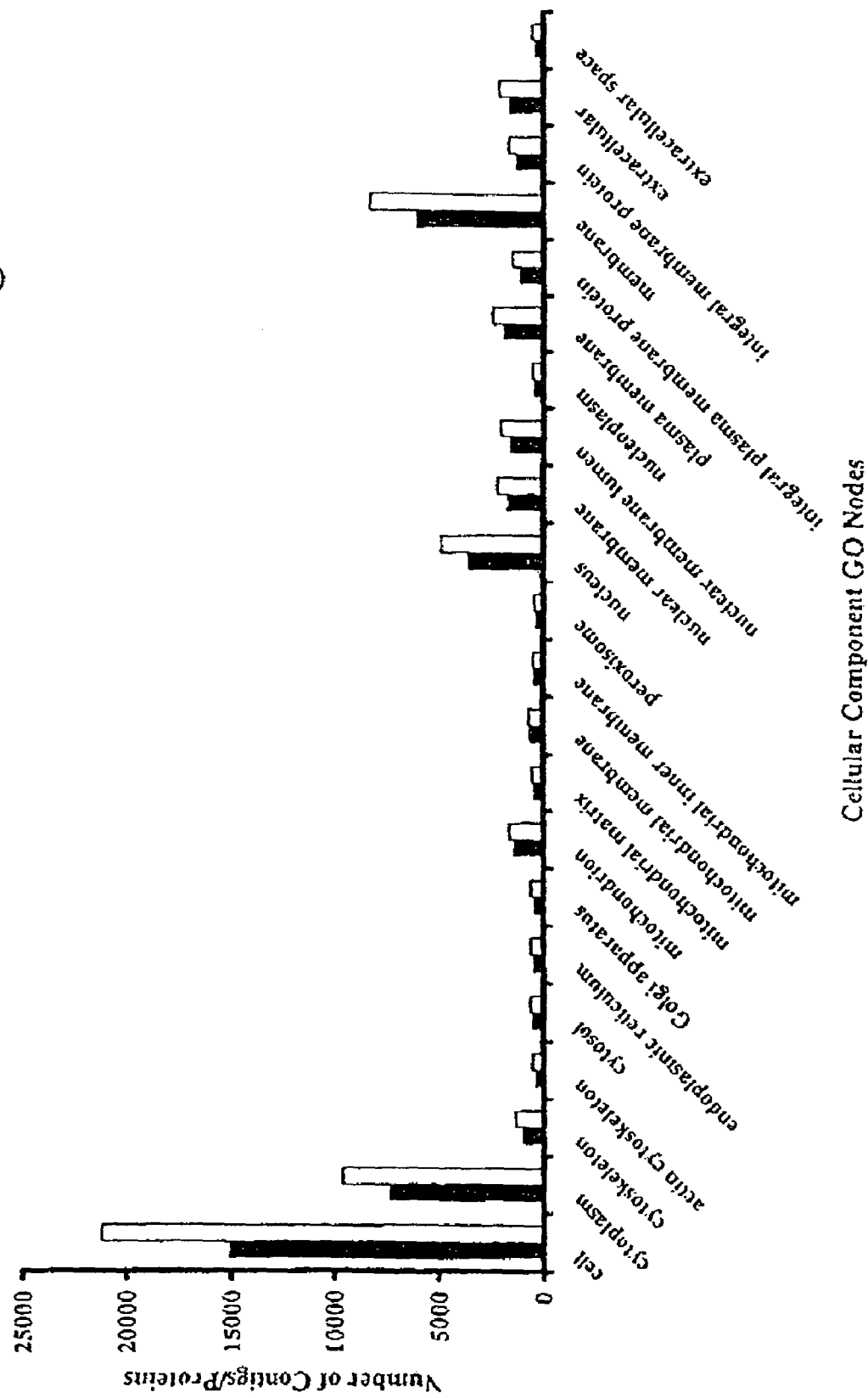
FIGS. 6a-c are histograms showing the distribution of proteins (closed squares) and contigs (opened squares) from Ensembl version 1.0.0 in the major nodes of three GO categories—cellular component (FIG. 6a), molecular function (FIG. 6b), and biological process (FIG. 6c).
Figure 6B:
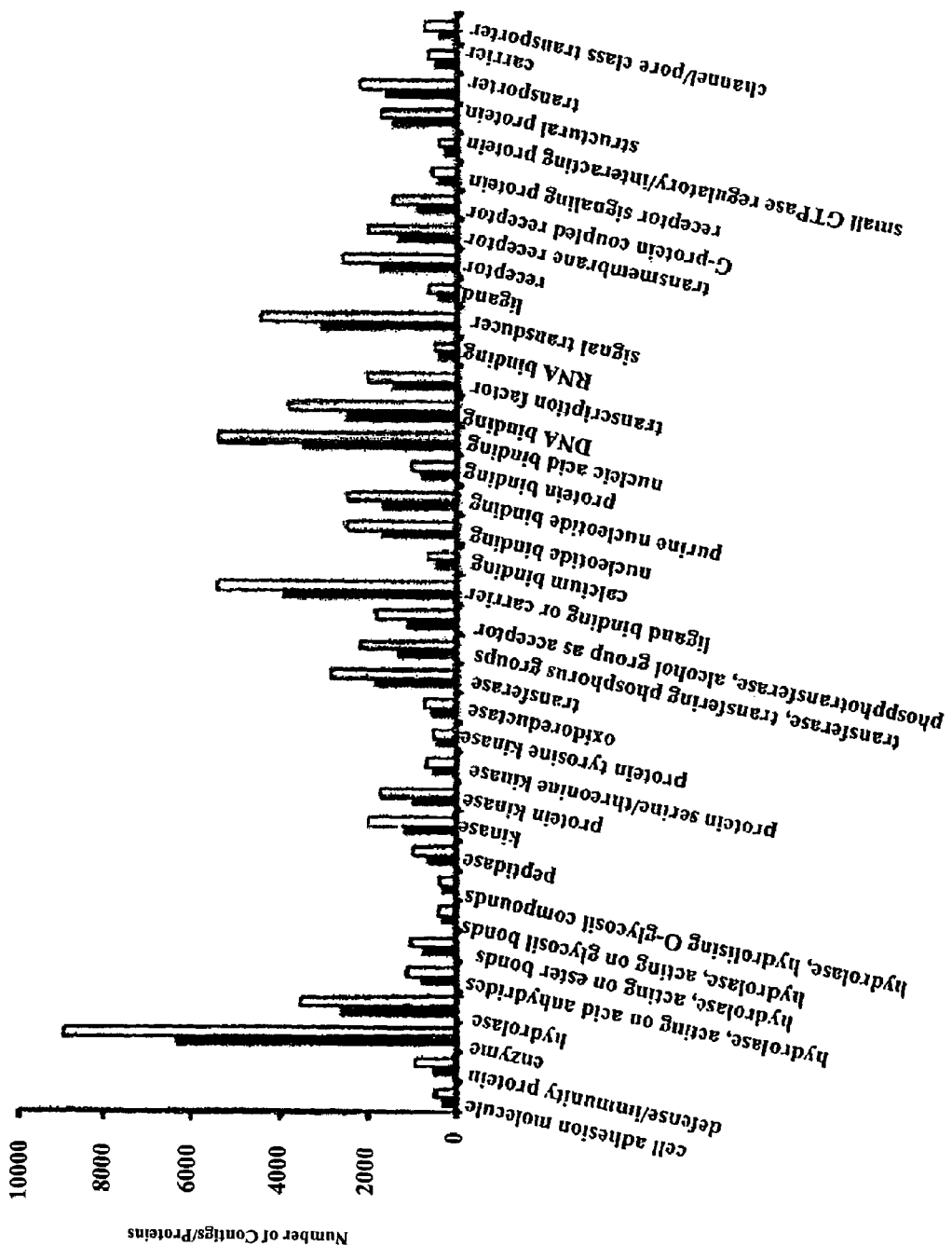
Figure 6C:
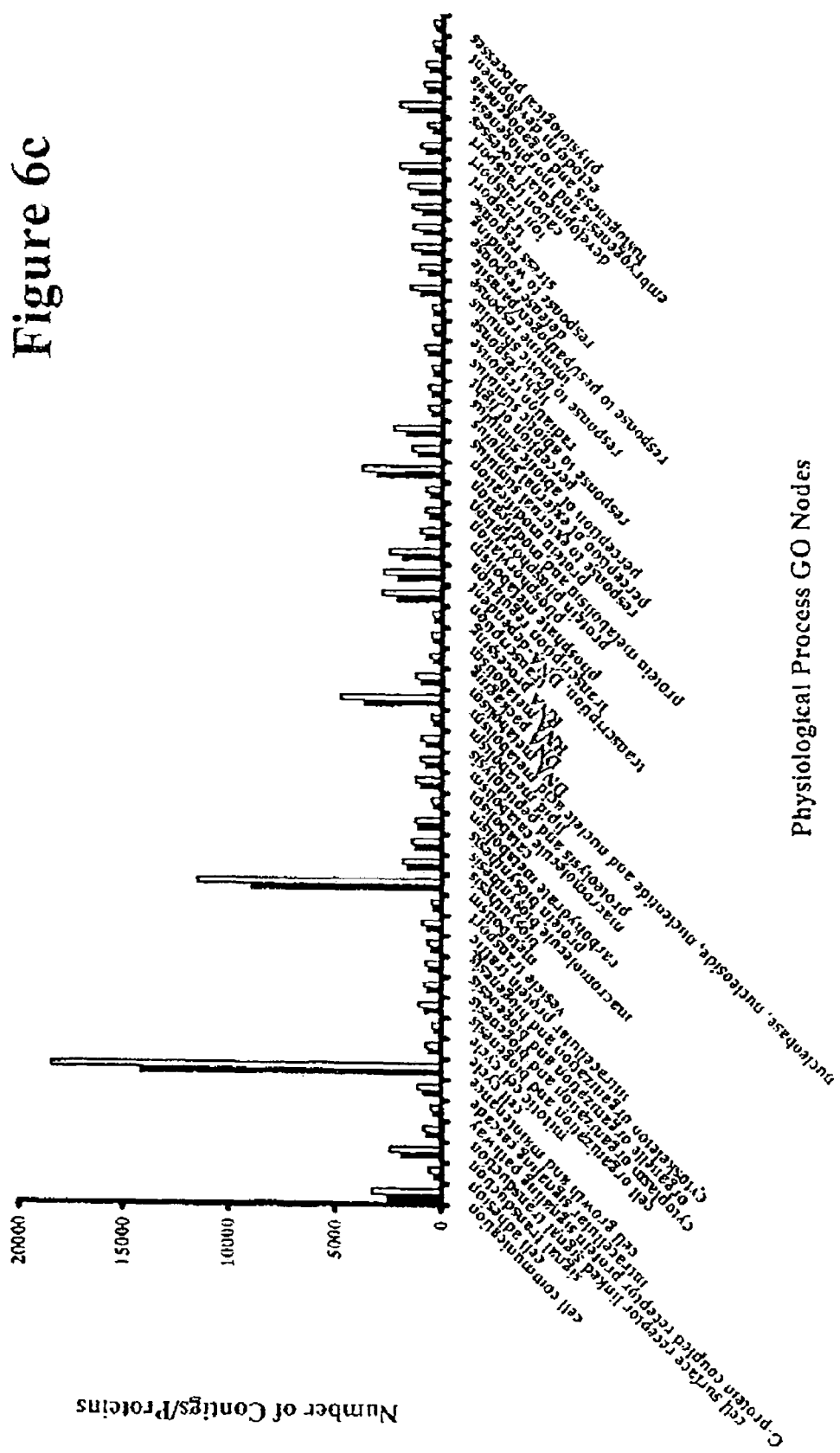

To examine clustering efficiency and homology transitivity, all homology pairs clustered with at least 90% identity were examined. At this level, there were a total of 57,004 clusters containing 263,259 protein members. Among these clusters, 23,231 clusters contained at least three protein members (see FIGS. 6a-c). The lowest homology pairs had an identity of 46% while being clustered at 90% or higher identity levels.

Clusters containing proteins with preassociated or predicted ontological annotations were analyzed and best annotations for individual proteins in the clusters were selected through an error weight calculation. Table 9 below, provides statistics on the number of input gene ontology annotations and the number of output annotations following processing.

TABLE 9

|  | Input | | Output |
|---|---|---|---|
|  | GO Consortium annotation, Enzyme conversion, InterPro mapping, etc. | Text mining ProLoc | |
| Cellular Component | 44702 | 522179 | 574607 |
| Molecular Function | 85626 | 526083 | 580767 |
| Biological Process | 69726 | 525842 | 578636 |

Over 85% of proteins were annotated with one or more GO nodes in each of three GO categories. Table 10 below, analyses the number of proteins annotated at different homology levels, showing that GO annotations were achieved throughout the homology spectra.

TABLE 10

|  | Cellular Component | Molecular Function | Biological Process |
|---|---|---|---|
| Text | 32257 | 34137 | 30149 |
| $10^{-2}$-$10^{-10}$ | 87967 | 71717 | 74277 |
| $10^{-10}$-$10^{-50}$ | 122992 | 70088 | 79318 |
| $10^{-50}$-0.0 | 98059 | 55132 | 59051 |
| 35%-75% | 111130 | 97209 | 108334 |
| 75%-90% | 38509 | 68282 | 67429 |
| 90%-99% | 38991 | 98576 | 90352 |
| Input GO | 44702 | 85626 | 69726 |

Example 9

Statistical Validation of Ontological Annotations

Gene ontology annotations, which were assigned according to the teachings of the present invention, were assessed by automatic cross-validation. One fifth of input of input GO annotations were withheld during the GO annotation process and the resultant annotations were compared with the withheld GO nodes. For each protein, the GO node with the lowest error score was examined. Table 11 below, lists the coverage and accuracy of such representative test.

TABLE 11

|  | Total | Predicted GO | Accurate GO |
|---|---|---|---|
| Cellular Component | 7431 | 7186 | 4642 |
| Molecular Function | 12999 | 12864 | 10138 |
| Biological Process | 10811 | 10690 | 8080 |

Evidently, sample coverage ranged from 96% to 99% and the reproducibility was between 65% and 80%. The lower reproducibility of GO annotations in the "cellular component" category, as compared with that in the other two GO categories was consistent with the notion that a short amino acid segment such as a signal peptide affects significantly protein localization. The presence or absence of such small amino acid segments could not be completely captured in sequence similarity comparisons. Detailed analysis of the validation of data indicated that the accuracy of the annotations correlated with the homology levels (data not shown). Manual validation of assigned annotations was performed on a total of 500 annotations and about 85%-93% of annotations were found to be correct. The higher percentage of accuracy in the manual examination over the automatic cross-validation resulted from the incomplete annotation of input GO.

Example 10

Description of Data

Example 10a-e below describe the data table in "Summary_table" file, on the attached CD-ROM3. The data table shows a collection of annotations of differentially expressed nucleic acid sequences, which were identified according to the teachings of the present invention.

Each feature in the data table is identified by "#".
Each transcript in the data table is identified by:

(i) A Serial number, e.g. "251470" in Example 10a, "445259"-"445262" in Example 10b. I (ii) An internal arbitrary transcript accession number, e.g. "N62228_4" in Example 10a, "BE674469_0", "BE674469_0_124", "BE674469_1", "BE674469_1_124" in Example 10b.

The first number of the internal transcript accession number is shared by all transcripts which belong to the same contig, and represent alternatively spliced variants of each other, e.g. "BE674469" in "BE674469_0", "BE674469_0_124", "BE674469_1", "BE674469_1_124" in Example 10b.

The second number of the internal transcript accession number is an internal serial transcript number of a specific contig, e.g. "_0" or "_1" in "BE674469_0", "BE674469_0_124", "BE674469_1", "BE674469_1_124" in Example 10b.

The third number of the internal transcript accession number is optional, and represents the GenBank database version used for clustering, assembly and annotation processes. Unless otherwise mentioned, GenBank database version 126 was used. "124" indicates the use of GenBank version 124, as in "BE674469_1_124" of Example 10b.

"ProDG" following the internal accession number indicates an EST sequence data from a proprietary source, e.g., Examples 3d and 3e.

"han" represents the use of GenBank version 125. This version was used in the annotation of lung and colon cancer specific expressed sequences.

"lab" indicates expressed sequences which differential pattern of expression has been confirmed in the laboratory.

Transcript accession number identifies each sequence in the nucleotide sequence data files "Transcripts_nucleotide_seqs_part1", "Transcripts_nucleotide_seqs_part2" and "Transcripts_nucleotide_seqs_part3" on CD-ROMs 1 and 2, and in the respective amino acid sequences data file "Protein.seqs" on CD-ROM2. Of note, some nucleotide sequence data files of the above, do not have respective amino acid sequences in the amino acid sequence file "Protein.seqs" attached on CD-ROM2.

Additional lines of the file contain the following information:

"*" indicates optional fields; "**" indicates repeatable features.

"#EST" represents a list of GenBank accession numbers of all expressed sequences (ESTs and RNAs) clustered to a contig, from which a respective transcript is derived. The GenBank accession numbers of these expressed sequences are listed only for the first transcript in the contig, e.g. "#EST BC006216,BE674469,BE798748,NM032716" in Example 10b. The rest of the transcripts derived from the same contig, are indicated by an #EST field marked with "the same".

Expressed sequences, marked with "ProDGyXXX", e.g., "ProDGy933" in Example 10d, and expressed sequences, marked with "GeneID XXX", e.g., "GeneID1007Forward" in Example 10e, are proprietary sequences which do not appear in GenBank database. These sequences are deposited in the nucleotide sequence file "ProDG_seqs" in the attached CD-ROM2.

Data pertaining to differentially expressed alternatively spliced sequences is presented in the following format:

*, ** "#TAA_CD" represents the coordinates of the differentially expressed sequence segment. A single number represents a differentially expressed edge, corresponding to the specific junction between 2 exons. "TAA_CD" represented by a pair of numbers represents the start and end positions of a differentially expressed sequence node. For example, "#TAA_CD 269 296" in Example 10a indicates that the transcript identified as N62228_4 contains a differentially expressed segment, located between the nucleotides at positions 269 and 296.

*, ** "#TAA_TIS" contains information pertaining to specific tissue(s), in which the respective transcript is predicted to be expressed differentially. Tumor tissues are indicated accordingly. For example, "#TAA_TIS lung Tumor" indicates that transcript BE674469_0 in Example 10b is predicted to be differentially expressed in lung tumor tissues.

*, ** "#DN" represents information pertaining transcripts, which contain altered functional domains, predicted to act in a dominant negative manner. This field lists the description of the functional domain(s), which is altered in the respective splice variants e.g., "#DN EGF-like domain" in Example 10a.

Functional annotations of transcripts based on Gene Ontology (GO) are indicated by the following format.

*, ** "#GO_P", annotations related to Biological Process,

*, ** "#GO_F", annotations related to Molecular Function, and

*, ** "#GO_C", annotations related to Cellular Component.

For each category the following features are optionally addressed:

"#GOPR" represents internal arbitrary accession number of the predicted protein corresponding to the functionally annotated transcript. This internal accession number identifies the protein in the amino acid sequence file "Protein.seqs" in the attached CD-ROM2, together with the internal arbitrary transcript accession number. For example, "#GOPR human_281192" in Example 10a, is a protein sequence encoded by transcript N62228_4, which appears in the amino acid sequence file "Protein.seqs" in the attached CD-ROM2 and is identified by both numbers, "N62228_4" and "human_281192".

"#GO_Acc" represents the accession number of the assigned GO entry, corresponding to the following "#GO_Desc" field.

"#GO_Desc" represents the description of the assigned GO entry, corresponding to the mentioned "#GO_Acc" field. For example, "#GO_Acc 7165 #GO_Desc signal transduction" in Example 10a, means that the respective transcript is assigned to GO entry number 7165, corresponding to signal transduction pathway.

"#CL" represents the confidence level of the GO assignment, when #CL1 is the highest and #CL5 is the lowest possible confidence level.

"#DB" marks the database on which the GO assignment relies on. The "sp", as in Example 10a, relates to SwissProt Protein knowledgebase, available from the ExPASy-Swiss Institute of Bioinformatics website. "InterPro", as in Example 10c, refers to the InterPro combined database, available from the European Bioinformatics Institute website, which contains information regarding protein families, collected from the following databases: SwissProt available at the European Bioinformatics Institute website, Prosite-available at the ExPASy-Swiss Institute of Bioinformatics website, Pfam-available at the website of Wellcome Trust Sanger Institute, Prints- available at the website of the Center for Bioinformatics and Computational Biology, Manchester University, UK, Prodom-available at the website of the Laboratoire de Génétique Cellulaire, INRA Toulouse, France; Smart-available at the website of the European Molecular Biology Laboratory, Heidelberg and Tigrfams- available at the website of the J. Craig Venter Institute.

"#EN" represents the accession of the entity in the database (#DB), corresponding to the best hit of the predicted protein. For example, "#DB sp #EN NRG2_HUMAN" in Example 10a means that the GO assignment in this case was based on SwissProt database, while the closest homologue to the assigned protein is depicted in SwissProt entry "NRG2_HUMAN", corresponding to protein named "Pro-neuregulin-2" (see entry O14511 at the ExPASy-Swiss Institute of Bioinformatics website). "#DB interpro #EN IPR001609" in Example 10c means that GO assignment in this case was based on InterPro database, while the best hit of the assigned protein is to protein family depicted in SwissProt accession number "IPR001609", corresponding to "Myosin head (motor domain)" protein family (available at the European Bioinformatics Institute website).

The following two fields correspond to the hierarchical assignment of the differentially expressed sequences to a specific tissue(s), based on the EST content and EST libraries' origin within the contig.

*, ** "#SA" indicates that tissue assignment requires a contig, containing at least 3 ESTs, where at least 80% thereof are assigned to a selected tissue.

*, ** "#RA" indicates that tissue assignment requires a contig derived from at least two different EST libraries, originally constructed from a specific tissue.

Example 10a

251470 N62228_4 #EST the_same #TAA_CD 269 296 #TAA_TIS ovary, #TAA_CD 269 296 #TAA_TIS ovary Tumor, #TAA_CD 269 296 #TAA_TIS skin Tumor, #TAA_CD 59 269 #TAA_TIS ovary, #TAA_CD 59 269 #TAA_TIS ovary Tumor, #TAA_CD 59 269 #TAA_TIS skin Tumor #DN EGF-like domain #GO_F #GOPR human__281192 #GO_Acc 3823 #GO_Desc antibody #CL 2 #DB sp #EN NRG2_HUMAN #GO_P #GOPR human__281192 #GO_Acc 7165 #GO_Desc signal transduction #CL 2 #DB sp #EN NRG2_HUMAN

Example 10b

445259 BE674469_0 #EST BC006216,BE674469, BE798748,NM032716 #TAA_CD 0 2537 #TAA_TIS lung, #TAA_CD 0 2537 #TAA_TIS lung Tumor 445260 BE674469_0_124 #124EST BC006216, BE674469,BE798748,NM__032716 #SA Lung Tumor #RA lung_cancer 445261 BE674469_1 #EST the_same #TAA_CD 0 2537 #TAA_TIS lung, #TAA_CD 0 2537 #TAA_TIS lung Tumor 445262 BE674469_1_124 #124EST BC006216, BE674469,BE798748,NM__032716 #SA Lung Tumor #RA lung_cancer

Example 10c

314251 HUMM7BA_0 #EST BF804381,BF805793, BF805830,BG978076,HUMM7BA #GO_C #GOPR human__313276 #GO_Acc 16459 #GO_Desc myosin #CL 2 #DB interpro #EN IPR001609 #GO_F #GOPR human__313281 #GO_Acc 3774 #GO_Desc motor #CL 1 #DB sp #EN Q14786 #GO_F #GOPR human__313281 #GO_Acc 5524 #GO_Desc ATP binding #CL 1 #DB sp #EN Q14786 #GO_P #GOPR human__313281 #GO_Acc 5983 #GO_Desc starch catabolism #CL 4 #DB sp #EN Q14786 #SA colon, colonic, gut #RA colon_normal

Example 10d

723873 AA157684_T0_ProDG #EST AA157684,AA157764,AK057980,BF355351, ProDGy933
GO_C #GO_Acc 0016021 #GO_Desc "integral membrane protein" #GO_F
GO_Acc 0005978 #GO_Desc "glycogen biosynthesis" #GO_P #GO_Acc 0003707 #GO_Desc "steroid hormone receptor"

Example 10e

723928 GeneID1007Forward_T0_ProDG #EST AC018755CDS1,AC018755mRNA1,AW403840, AY040820CDS0,BF3 59557, BF896787,BF898989, BF899932,BF900235,BF905509,BI518761,BI756629,BI 822428,BI906477,BI906754,BM550096,BM922784, GeneID1007Forward,Gen eID285Forward,ProDGy1006 #GO_C #GO_Acc 0005887 #GO_Desc "integral plasma membrane protein" #GO_F #GO_Acc 0007267 #GO_Desc "cell-cell signaling"#GO_P #GO_Acc 0005530 #GO_Desc "lectin"

Example 11

Description of the Sequence Files on the Enclosed CD-ROM

The sequences in the CD-ROM sequence files are in FastA text format. Each transcript sequence starts with ">" mark, followed by the transcript internal accession number. The proprietary ProDG EST sequences starts with ">" mark, followed by the internal sequence accession. An example of the sequence file is presented below.

Example 11a

```
>R42278_0
                                         (SEQ ID NO: 41)
TGTTTTAGAAATCTCATGATTCCCAGGAAAAAAATTTTAAATTGTGATAC

AGGTTTGACAGCCTTTTAGTCAAATAAGTTAAAACACACACGCAAACTCA

TTTACTCACTTTGCCATTATAATTCAATCACAAAGAAATTTTGGCCAGGC

GTGGTGGTTACGCCTGTAATCCCAGCACTTTGGGAGGCCGAGGCAGGTGG

ATCACGAGGTCAGGGATCAAGATCATCCTGGCTAACATGTGAAACCCCG

TCTCTATTAAAAATAAAAAATTAGCCTGGTGTGGTGGCGGGTGCCTGTAG

TCCCAGCTACTCGGGAGGCTGAGGCAGCAGAATGGCGTGAACTCAGGAGG

CGGAGCTTGCAGTGAGCCGAGATCGCGCCACTGCACTCCAGCCTGGATGA

CAGAGCGAGACTCCATCTCAAAAAAAAAA
```

Example 11b

```
>GeneIDReverse #TY RNA #DE ProDGy sequence #DT
18-JUN-1000 #DR 5 #LN 348
                                         (SEQ ID NO: 1)
GTGGTTATTACAGCATGGTTCCCAGCCTTACAGTGTCTAAGTGCTTCTCT

TGTGTCCTGTAGATGTTGTGAAAAAGAAAAAAACAAAAAATACACCACAC
```

-continued
TGTACTTTTTCCCCCTGCCCCCGTTACTGCCGGTGATTATTATTAAAAAT

TAGTTTTTTTCACATCATTATATCTGGCTTCCTATAAACAACAGCCTTAA

TTCAGTCAAGACTCCCTTTGGGGAATTCATTTTATTAAAAATTGGTGTCT

GGATACTTCCCTGTACATGCATAAATATGCATGCATGTACAGAAAGACTG

TATGTGTGTGCCTTGCACACACACCCATACCTCTCAGAAAAGTGTTT

Example 11c

```
>ProDGy1339 #OS Homo sapiens #DE ProDGy sequence
#DT 26-JUL-2002 #TY EST #DR 5 #AC ProDGy1339
#LN 132
                                      (SEQ ID NO: 2)
CAGAAAGCCCAGAGTAGTCCCTGTAAGAAGCTGAGGGGCGCATACCTCTG

GGGTTTGGGTTCCCTTCAGGGAAGCGAAGGGAGATGACCTCTTTCCAGGC

TGGGGACCAAGAGGGCTCCCTAGAAGATATTA
```

Example 12

Description of the CD-ROM Content

The CD-ROMs enclosed herewith contain the following files:

CD-ROM1 (1 file):
1. "Transcripts_nucleotide_seqs_part1", containing nucleotide sequences of all the transcripts based on genomic production of GenBank version 126.

CD-ROM2 (4 files):
1. "Transcripts_nucleotide_seqs_part2", containing nucleotide sequences of all the transcripts based on expressed production of GenBank version 126 (in cases where no genomic data support was available).
2. "Transcripts_nucleotide_seqs_part3.new", containing nucleotide sequences of all the transcripts based on GenBank versions 124, 125, and transcripts containing ProDG proprietary sequences.
3. "Protein.seqs", containing all the amino acid sequences encoded by the transcripts of the invention.
4. "ProDG_seqs", containing the proprietary EST sequences.

CD-ROM3 (1 file):
1. "Summary_table.new", containing all the annotation information, as described in Example 10.

CD-ROM4 (1 file):
1. "Pat11_US8_Patentin-part1", containing part 1 of the PatentIn format Sequence Listing.

CD-ROM5 (1 file):
1. "Pat11_US8_Patentin-part2", containing part 2 of the PatentIn format Sequence Listing.

CD-ROM6 (1 file):
1. "Pat11_US8_Patentin-part3", containing part 3 of the PatentIn format Sequence Listing.

Example 13

In-vitro Confirmation of Differentially Expressed Transcripts

Experimental Procedures and Reagents

In-vitro confirmation of in-silico obtained differentially expressed polynucleotide sequences was effected utilizing laboratorial methodologies, based on nucleotide hybridization including northern analysis, RT-PCR and real-time PCR.

RNA preparation—Total RNA was isolated from the indicated cell lines or tumor tissues using the Tri-Reagent (Molecular Research Center Inc.) following the manufacturer's recommendations. Poly(A) RNA was purified from total RNA using oligo(dT)$_{25}$ Dynabeads (Dynal).

Northern blotting—20 μg of total RNA or 2 μg of poly(A) RNA were electrophoresed on 1% agarose gels containing formaldehyde, and blotted onto Nytran Super Charge membranes (Shcleicher & Schuell). Hybridization was carried out using a DNA probe (SEQ ID NO: 3) in EZ-Hybridization Solution (Biological Industries, Beit Haemek, Israel) at 68° C. for 18 hrs. The membranes were rinsed twice with 2×SSC, 0.1% SDS at room temperature, followed by two washes with 0.1×SSC, 0.1% SDS at 50° C. Autoradiograms were obtained by exposing the membranes to X-ray films.

RT-PCR analysis—Prior to RT reactions, total RNA was digested with DNase (DNA-free™, Ambion) in the presence of RNasin. Reverse transcription was carried out on 2 μg of total RNA, in a 20 μl reaction, using 2.5 units of Superscript II Reverse Transcriptase (Bibco/BRL) in the buffer supplied by the manufacturer, with 10 pmol of oligo(dT)$_{25}$ (Promega), and 30 units of Rnasin (Promega). RT reactions, were standardized by PCR with GAPDH-specific primers, for 20 cycles. The calibrated reverse transcriptase samples were then analyzed with gene-specific primers either at 35 cycles, or at lower cycles (15 and 20 cycles). PCR products of lower number of cycles were visualized by southern blotting, followed by hybridization with the appropriate probe (the same PCR product).

Real-Time RT-PCR—Total RNA samples were treated with DnaseI (Ambion) and purified with Rneasy columns (Qiagen). 2 μg of treated RNA samples were added into 20 μl RT-reaction mixture including. RT-PCR end product 200 units SuperscriptII (Invitrogen), 40 units RNasin, and 500 pmol oligo dT. All components were incubated for 1 hr at 50° C. and then inactivated by incubation for 15 min at 70° C. Amplification products were diluted, 1:20, in water. 5 μl of diluted products were used as templates in Real-Time PCR reactions using specific primers and the intercalating dye Sybr Green.

The amplification stage was effected as follows, 95° C. for 15 sec, 64° C. for 7 sec, 78° C. for 5 sec and 72° C. for 14 sec. Detection was effected using Roch light cycler detector. The cycle in which the reactions achieved a threshold level of fluorescence was registered and served to calculate the initial transcript copy number in the RT reaction. The copy number was calculated using a standard curve created using serial dilutions of a purified amplicon product. To minimize inherent differences in the RT reaction, the resulting copy number was normalized to the levels of expression of the housekeeping genes Proteasome 26S subunit (GenBank Accession number D78151) or GADPH (GenBank Accession number: AF261085).

Semiquantitative PCR—RT-PCR reaction was performed with sample specific primers, for 16 cycles. PCR products were used as probes. Labeling procedure was carried out using "Random primer DNA labeling mix" according to manufacturer's instructions (Cat. No: 20-101-25). Briefly, 25 ng of template DNA were denatured by heating to 100° C. for 5 minutes, and then chilled on ice for 5 minutes. Labeling solution contained 11 μl of denatured DNA, 4 μl of labeling mix solution (Biological industries), 5 μl of $^{32}$(p)dCTP (Amersham, Pharmacia, AA0005). Labeling was effected for 10 minutes in 37° C. Removal of unincorporated nucleotides was effected using Sephadex G-50 columns. Prior to hybridization, labeled DNA was denatured by heating to 100° C. for 5 minutes and then rapidly cooled on ice.

Southern blotting—PCR products were separated on 1.5% agarose gel and size separated. The gel was denatured by two consecutive washes for 20 min in 1× denaturation buffer, containing 1.5M NaCl, 0.5M NaOH. Thereafter a neutralization procedure was effected by washing twice for 20 min in 1× neutralization buffer, containing 1.5M Nacl, 0.5m Tris/HCL pH=7.0. Blotting of the denatured DNA to the nylon membrane was performed overnight with 20×SSC. DNA was UV crosslinked (Stratalinker) to a nylon membrane prior to prehybridization step. Prehybridization was performed using EZ-hybridization solution (Biological Industries, Cat no: 01-889-1B) at 68° C. for 1 hour. The DNA blot was subjected to Southern hybridization using specific oligonucleotides end-labeled with adenosine 5'-[$\gamma$-$^{32}$P]triphosphate (>5000 Ci/mmol, Amersham Biosciences, Inc.). Hybridization step was effected at 68° C. for 16 hours.

Following hybridization the membrane was washed at gradually increasing stringent conditions: twice in 2×SSC, 0.1% SDS, for 15 min. at room temperature and twice in 0.1×SSC, 0.1% SDS, for 15 min, at 60° C. Radioactive signal was visualized by autoradiography.

Example 14

Colorectal Cancer Specific Expression of AA535072

AA535072 (SEQ ID NO: 39) is a common sequence feature to a series of overlapping sequences (SEQ ID NOs: 4, 24-28) with predicted amino acid sequences provided in SEQ ID NOs: 35-38.

The indicated tissues and cell lines were examined for AA535072 (SEQ ID NOs: 39) expression by RT-PCR analysis. Primers for AA535072 were GTGACAGCCAGTAGCTGCCATCTC (SEQ ID NO: 5) and TCCGTTTCTAGCGGCCAGACCTTT (SEQ ID NO: 6). PCR reactions were denatured at 94° C. for 2 minutes followed by 35 cycles at 94° C. for 30 sec, 64° C. for 30 sec and 72° C. for 60 sec. All PCR products were separated on an ethidium bromide stained gel.

Figure 7:
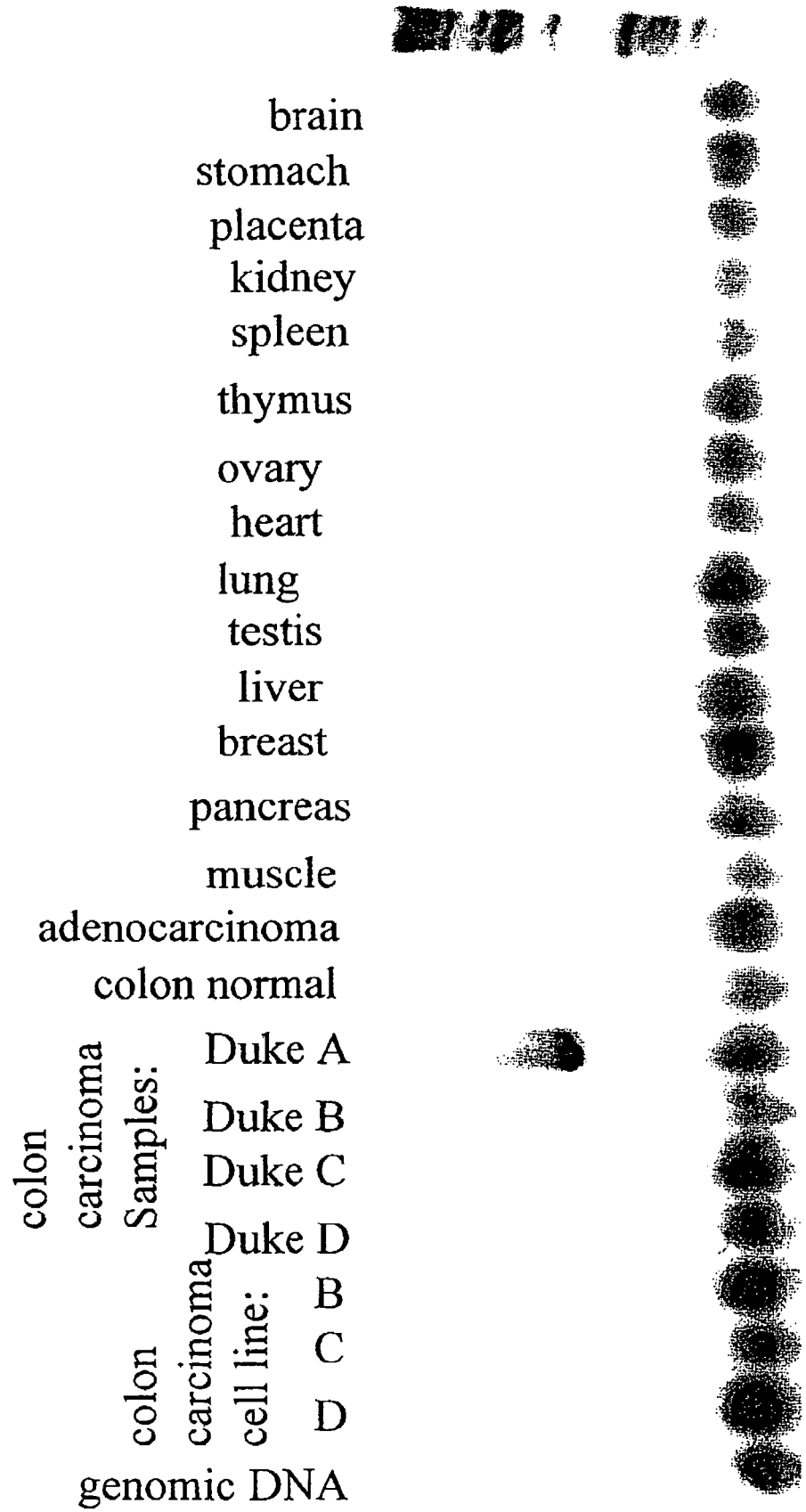
FIG. 7 illustrates results from RT-PCR analysis of the expression pattern of the AA535072 (SEQ ID NO: 39) colorectal cancer-specific transcript. The following cell and tissue samples were tested: B-colon carcinoma cell line SW480 (ATCC-228); C-colon carcinoma cell line SW620 (ATCC-227); D-colon carcinoma cell line colo-205 (ATCC-222). Colon normal tissue indicates a pool of 10 different samples, (Biochain, cat no A406029). The adenocarcinoma sample represents a pool of spleen, lung, stomach and kidney adenocarcinomas, obtained from patients. Each of the tissues (i.e., colon carcinoma samples Duke's A-D; and normal muscle, pancreas, breast, liver, testis, lung, heart, ovary, thymus, spleen kidney, placenta, stomach, brain) were obtained from 3-6 patients and pooled.

As shown in FIG. 7 amplification yielded a major PCR product of 1000 bp. Evidently, AA535072 expression was limited to colorectal cancer tissues; adenocarcinoma, colon carcinoma cell line and colon carcinoma Duke A cells. Since colon carcinoma Duke A cells represent an early stage of colon cancer progression, differentially expressed AA535072 can be used as a putative marker of polyps and benign stages of colon cancer. Furthermore, corresponding protein products (SEQ ID NOs: 35-38) may be utilized as important colon cancer specific diagnostic and prognostic tools.

Example 15

Bone Tumor Ewing's Sarcoma Specific expression of AA513157 (SEQ ID NO: 7)

The indicated tissues and cell lines were examined for AA513157 (SEQ ID NO: 7) expression by RT-PCR analysis. Primers for SEQ ID NO: 7 were GAAGGCAGGCGGATGCTACC (SEQ ID NO: 8) and AGCCTTCCACGCTGTACACGCCA (SEQ ID NO: 9). PCR reactions were denatured at 94° C. for 2 minutes followed by 35 cycles at 94° C. for 30 sec, 64° C. for 30 sec and 72° C. for 45 sec. All PCR products were separated on an ethidium bromide stained gel.

Figure 8:
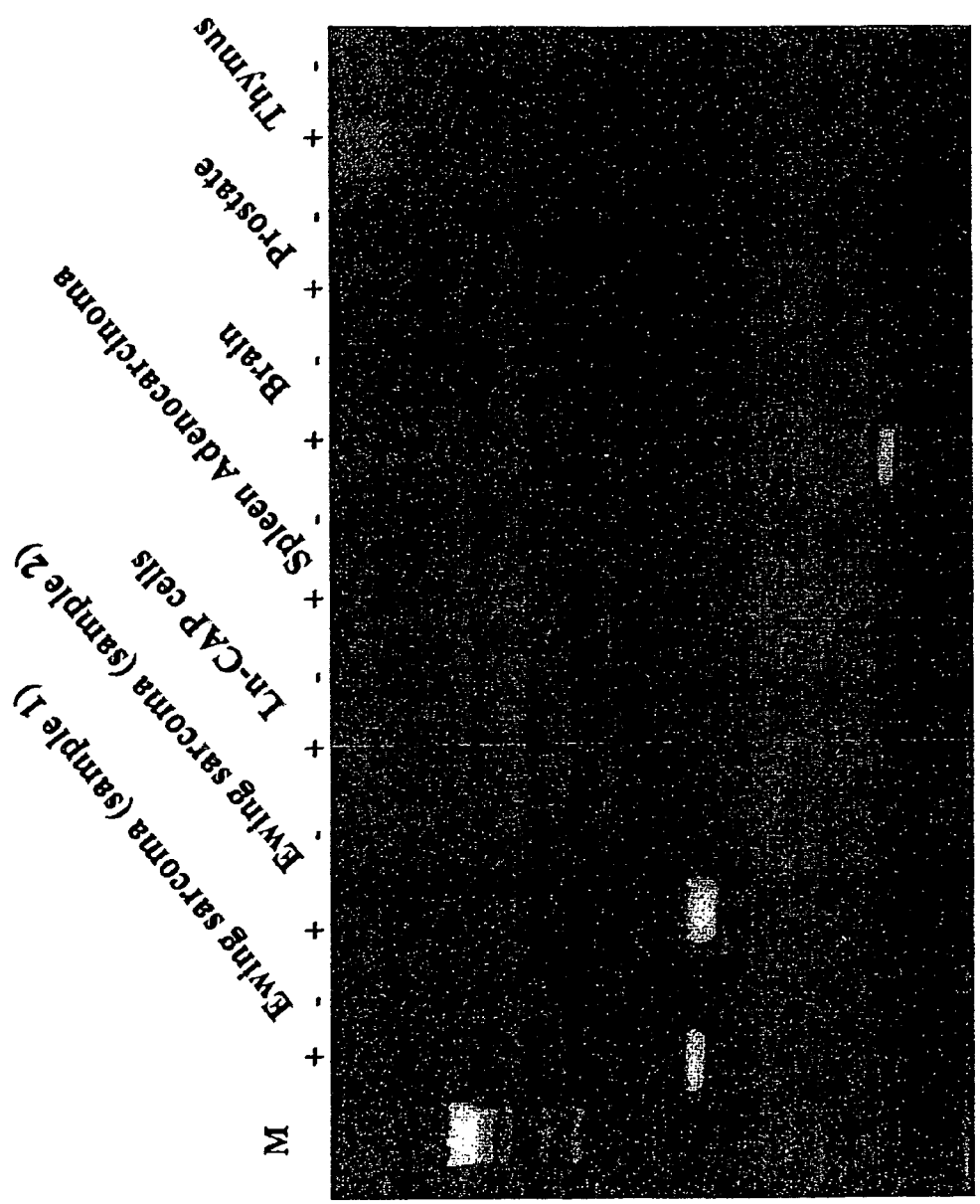
FIG. 8 illustrates results from RT-PCR analysis of the expression pattern of the AA513157 (SEQ ID NO: 7) Ewing sarcoma specific transcript. The (+) or (−) symbols, indicate presence or absence of reverse transcriptase in the reaction mixture. A molecular weight standard is indicated by M. Tissue samples (i.e., Ewing sarcoma samples, spleen adenocarcinoma, brain, prostate and thymus) were obtained from patients. The Ln-CAP human prostatic adenocarcinoma cell line was obtained from the ATCC (Manassas, Va.).

As shown in FIG. 8, amplification reaction yielded a specific PCR product of 600 bp. As shown in FIG. 8, in the presence of reverse transcriptase (indicated by +) high expression of AA513157 was evident in both samples of Ewing sarcoma, while only residual expression of AA513157 was seen in Ln-Cap cells, brain and splenic adenocarcinoma.

Figure 9:
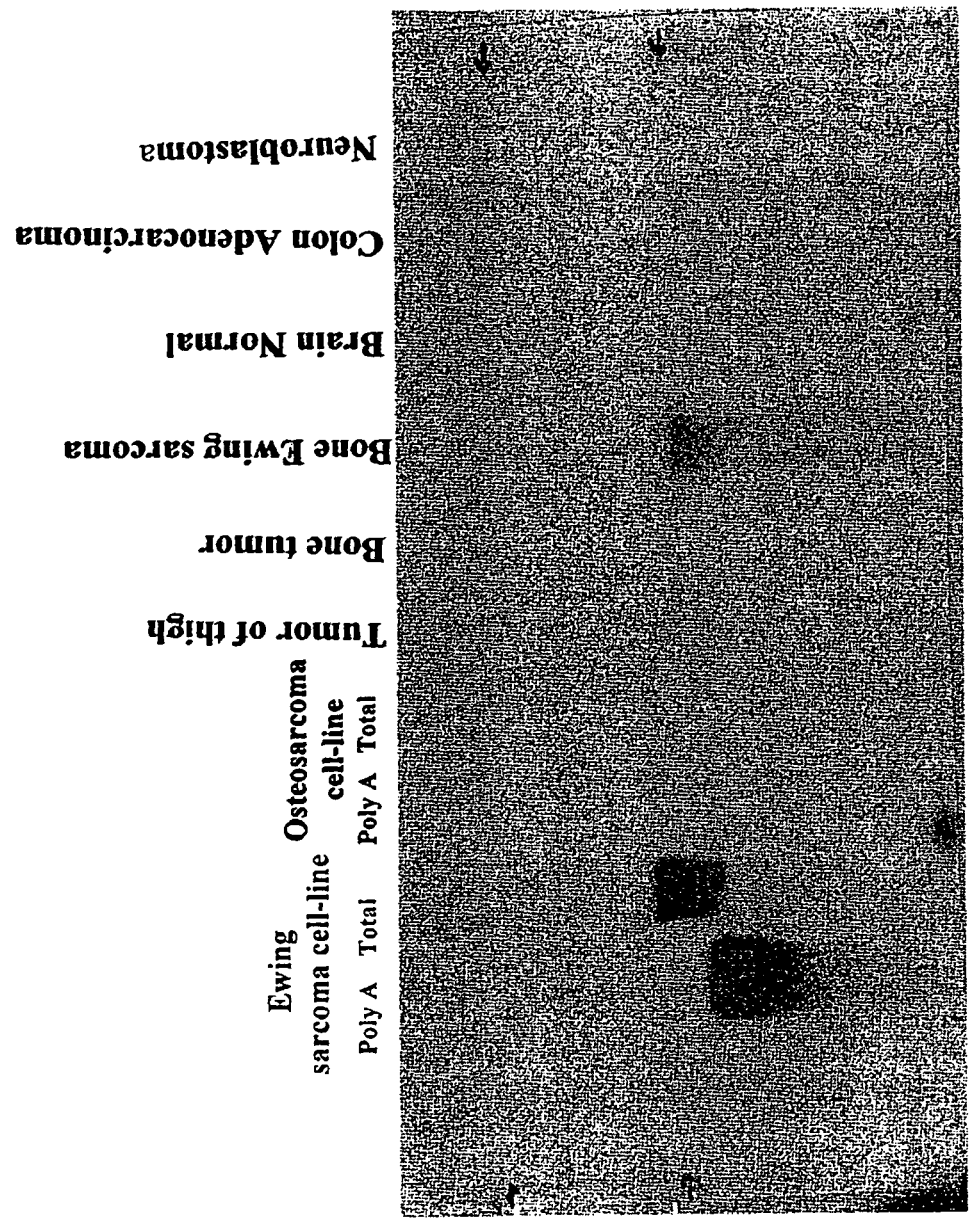
FIG. 9 is an autoradiogram of a northern blot analysis depicting tissue distribution and expression levels of AA513157 (SEQ ID NO: 7) Ewing sarcoma specific transcript. Arrows indicate the molecular weight of 28S and 18S ribosomal RNA subunits. The indicated tissue samples were obtained from patients and SK-ES-1-Ewing sarcoma cell-line was obtained from the ATCC (CRL-1427).

To substantiate these, Northern blot analysis of AA513157 was effected. The following primers were used, GAAGGCAGGCTGGATGCTACC (SEQ ID NO: 10), GGTAGTATAACCGGGCTCTGT (SEQ ID NO: 11). FIG. 9 illustrates RNA expression of AA513157 in various tissues. Several transcripts were evident upon Northern analysis: two major transcripts of 800 bp and 1800 bp from ployA RNA preparation and total RNA preparation, respectively. Expression of both transcripts was limited to the Ewing sarcoma cell line. Low expression of the 1800 bp transcript was evident in Bone Ewing sarcoma tissue as well.

These results corroborate AA513157 as a putative Ewing sarcoma marker and a putative pharmaceutical target.

Example 16

Colorectal Cancer Specific Expression of AA469088

AA469088 (SEQ ID NO: 40) is a common sequence feature to a series of overlapping sequences (SEQ ID NOs: 12 and 29-31).

The indicated tissues and cell lines were examined for AA469088 (SEQ ID NO: 40) expression by semi quantitative RT-PCR analysis. Primers for AA469088 were CATATTTCACTCTGTTCTCTCACC (SEQ ID NO: 13) and CAGAATGGGATTATGGTAGTCTATCT (SEQ ID NO: 14). PCR reactions were effected as follows: 14 cycles at 92° C. for 20 sec, 59° C. for 30 sec and 68° C. for 45 sec. The PCR products were size separated on agarose 1.5% gel, and undergone Southern blot analysis using the PCR products as specific probe, as described in details in Example 13. The visualization of the hybridization signal of the PCR products was performed by autoradiogram exposure to X-ray film.

Figure 10:
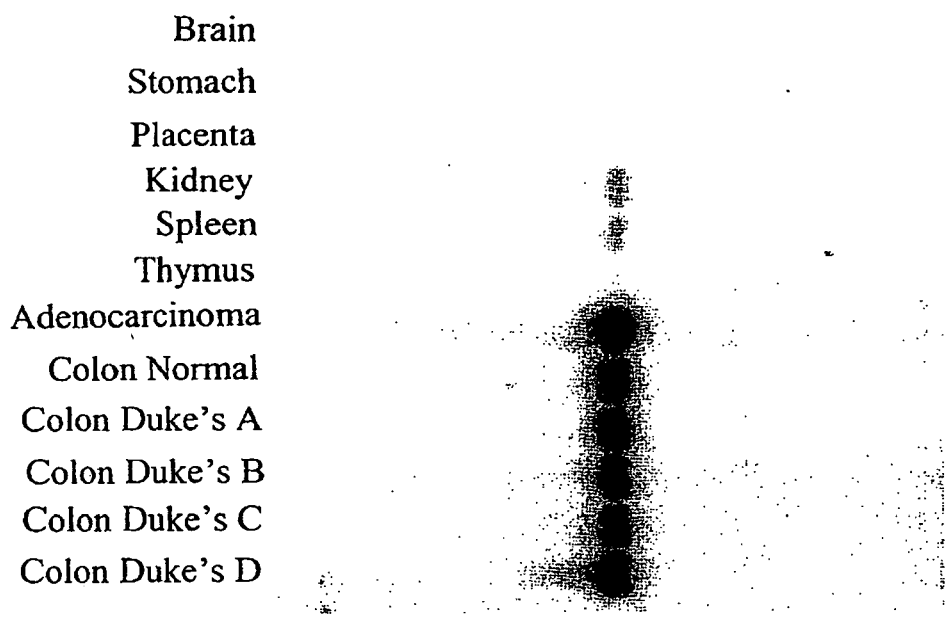
FIG. 10 illustrates results from semi quantitative RT-PCR analysis of the expression pattern of the AA469088 (SEQ ID NO: 40) colorectal specific transcript. Colon normal was obtained from Biochain, cat no: A406029. The adenocarcinoma sample represents a pool of spleen, lung, stomach and kidney adenocarcinomas, obtained from patients. Each of all other tissues (i.e., colon carcinoma samples Duke's A-D; and normal thymus, spleen, kidney, placenta, stomach, brain) were obtained from 3-6 patients and pooled.

As shown in FIG. 10 amplification reaction yielded a major PCR product of 484 bp. Evidently, AA469088 expression was limited to colorectal tumor tissues, normal colon and adenocarcinoma with only minor expression in the spleen and kidney.

Example 17

HUMMCDR—A Lung Cancer Specific Marker

Real-time quantitative RT-PCR was used to measure the mRNA steady state levels of HUMMCDR (SEQ ID NO: 15). The following primers were used CTTCAATTGGATTATGTTGACCTCTAC (SEQ ID NO: 16) and CACTATAGGCAACCAGAACAATGTC (SEQ ID NO: 17).

Figure 11:
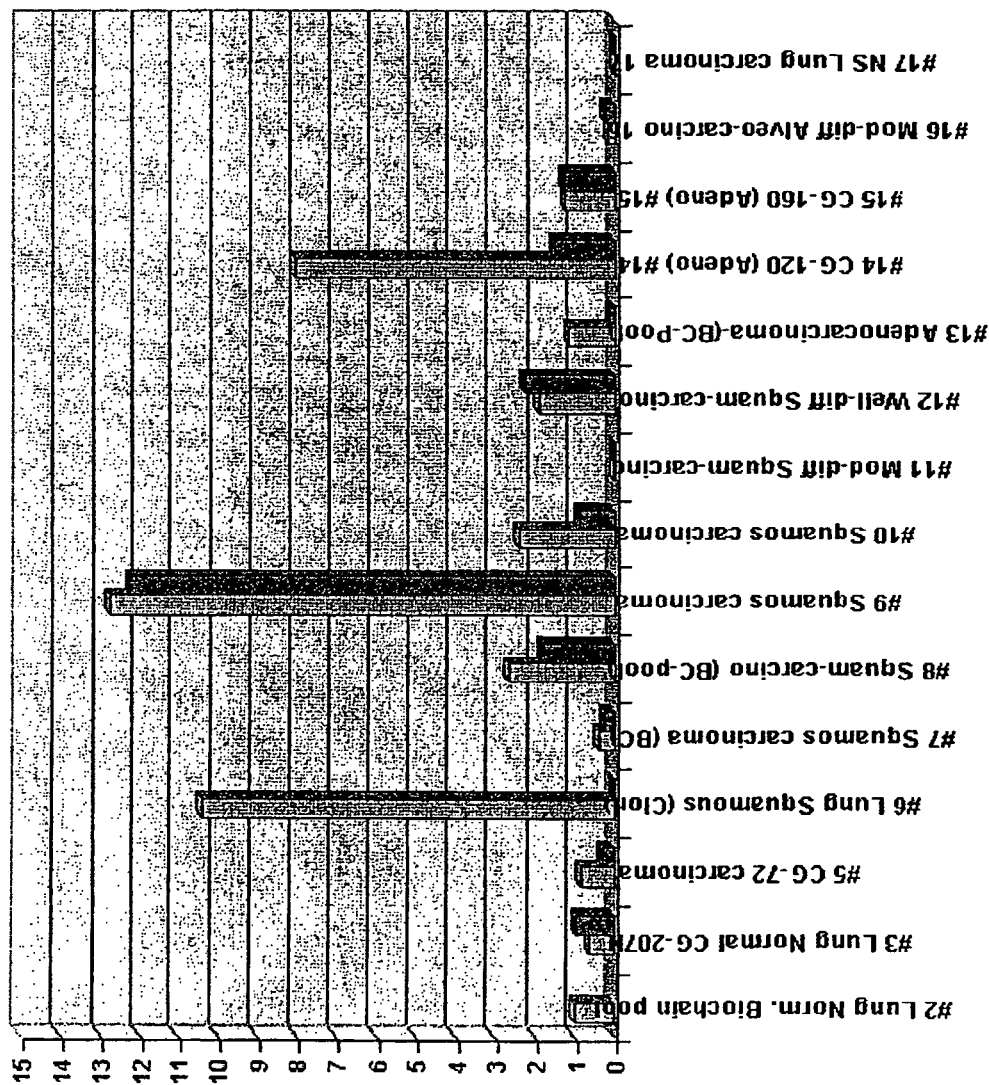
FIG. 11 is a histogram depicting Real-Time RT-PCR quantification of copy number, of a lung specific transcript, (SEQ ID NO: 15). Amplification products obtained from the following tissues were quantified; normal salivary gland from total RNA (Clontech, cat no: 64110-1); lung normal from pooled adult total RNA (BioChain, cat no: A409363); lung tumor squamos cell carcinoma (Clontech, cat no: 64013-1); lung tumor squamos cell carcinoma (BioChain, cat no: A409017); pooled lung tumor squamos cell carcinoma (BioChain, cat no: A411075); moderately differentiated squamos cell carcinoma (BioChain, cat no: A409091); well differentiated squamos cell carcinoma (BioChain, cat no: A408175); pooled adenocarcinoma (BioChain, cat no: A411076); moderately differentiated alveolus cell carcinoma (BioChain, cat no: A409089); non-small cell lung carcinoma cell line H1299; The following normal and tumor samples were obtained from patients: normal lung (internal number-CG-207N), lung carcinoma (internal number-CG-72), squamos cell carcinoma (internal number-CG-196), squamos cell carcinoma (internal number-CG-207), lung adenocarcinoma (internal number-CG-120), lung adenocarcinoma (internal number-CG-160). Copy number was normalized to the levels of expression of the housekeeping genes Proteasome 26S subunit (dark columns) and GADPH (bright columns).

Real-time PCR analysis (FIG. 11) indicates that SEQ ID NO: 15 is specifically expressed in lung squamous cell carcinoma with an evident 2-10 fold higher expression than in normal lung samples.

Example 18

SEQ ID NO: 18—A Lung Cancer Specific Transcript

Real-time quantitative RT-PCR was used to measure the mRNA steady state levels of SEQ ID NO: 18. The following primers were used GCGAGGACCGGGTATAAGAAGC (SEQ ID NO: 19) and TCGGCTCAGCCAAACACTGTCAG (SEQ ID NO: 20).

Figure 13:
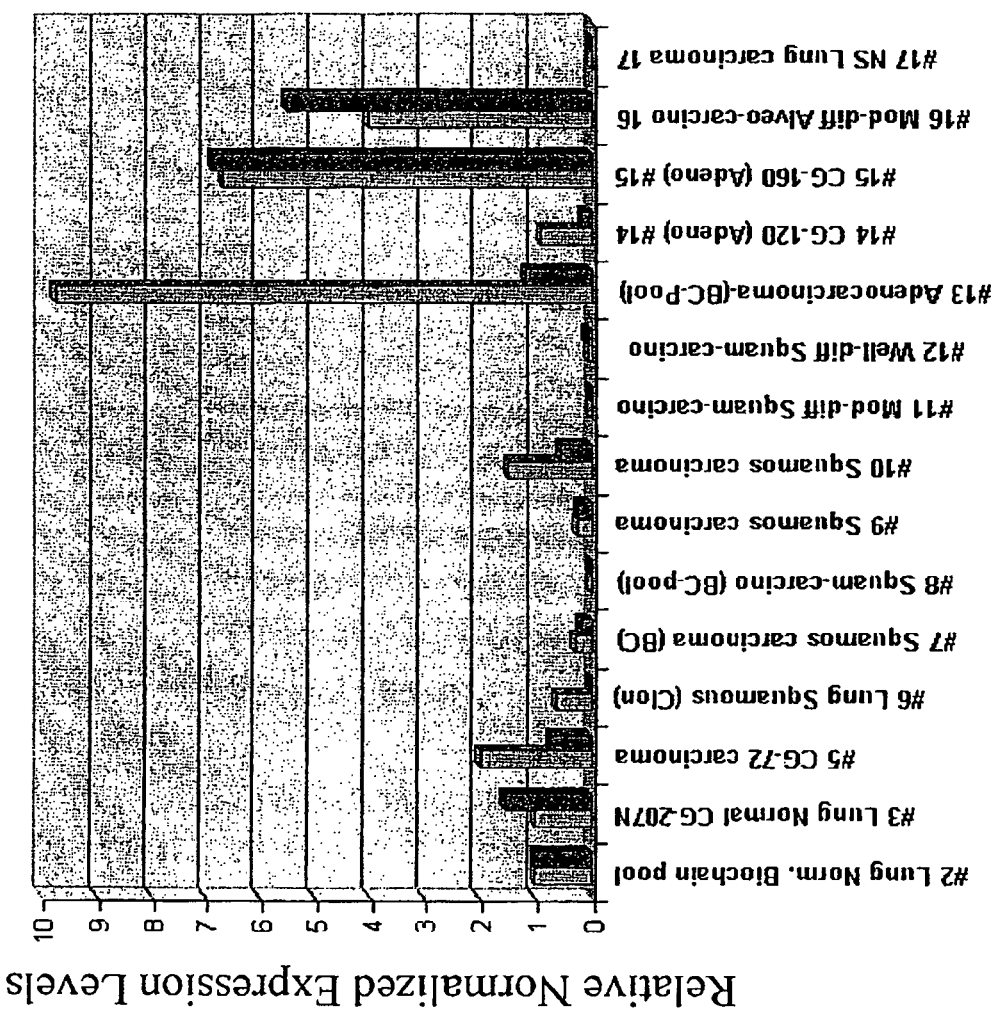
FIG. 13 is a histogram depicting Real-Time RT-PCR quantification of copy number, of the lung specific transcript (SEQ ID NO: 18). Amplification products obtained from the following tissues and cell-lines were quantified; lung normal from pooled adult total RNA (BioChain, cat no: A409363); lung tumor squamos cell carcinoma (Clontech, cat no: 64013-1); lung tumor squamos cell carcinoma (BioChain, cat no: A409017); pooled lung tumor squamos cell carcinoma (BioChain, cat no: A411075); moderately differentiated squamos cell carcinoma (BioChain, cat no: A409091); well differentiated squamos cell carcinoma (BioChain, cat no: A408175); pooled adenocarcinoma (BioChain, cat no: A411076); moderately differentiated alveolus cell carcinoma (BioChain, cat no: A409089); non-small cell lung carcinoma cell line H1299; The following normal and tumor samples were obtained from patients: normal lung (internal number-CG-207N), lung carcinoma (internal number-CG-72), squamos cell carcinoma (internal number-CG-196), squamos cell carcinoma (internal number-CG-207), lung adenocarcinoma (internal number-CG-120), lung adenocarcinoma (internal number-CG-160). Copy number was normalized to the levels of expression of the housekeeping genes Proteasome 26S subunit (dark columns) and GADPH (bright columns).

Real-time PCR analysis indicates that SEQ ID NO: 18 is specifically expressed in lung adenocarcinoma samples and in lung alveolus cell carcinoma (FIG. 13).

Example 19

SEQ ID NO: 21—A Lung Cancer Specific Transcript

Real-time quantitative RT-PCR was used to measure the mRNA steady state levels of SEQ ID NO: 21. The following primers were used GCTTCGACCGGCTTAGAACT (SEQ ID NO: 22) and GGTGAGCACGATACGGGC (SEQ ID NO: 23).

Figure 14:
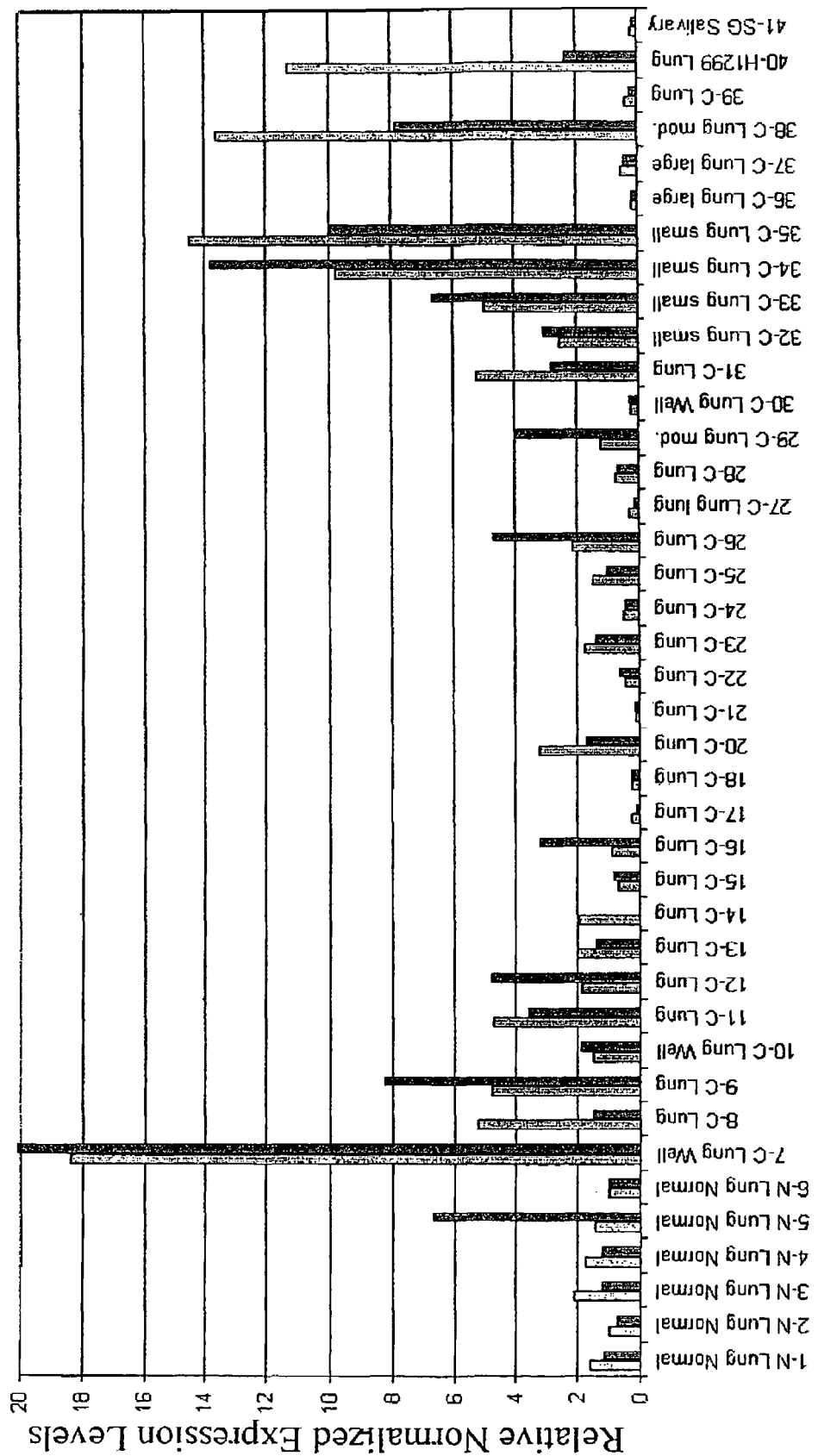
FIG. 14 is a histogram depicting Real-Time RT-PCR quantification of copy number, of a lung specific transcript (SEQ ID NO: 21). Amplification products obtained from the following tissues and cell-lines were quantified; Samples 1-6 are commercial normal lung samples (BioChain, CDP-061010; A503205, A503384, A503385, A503204, A503206, A409363). Sample 7 is lung well differentiated adenocarcinoma (BioChain, CDP-064004A; A504117). Sample 8 is lung moderately differentiated adenocarcinoma (BioChain, CDP-064004A; A504119). Sample 9 is lung moderately to poorly differentiated adenocarcinoma (BioChain, CDP-064004A; A504116). Sample 10 is lung well differentiated adenocarcinoma (BioChain, CDP-064004A; A504118). Samples 11-16 are lung adenocarcinoma samples obtained from patients. Sample 17 is lung moderately differentiated squamous cell carcinoma (BioChain, CDP-064004B; A503187). Sample 18 is lung squamous cell carcinoma (BioChain, CDP-064004B; A503386). Samples 20-21 are lung moderately differentiated squamous cell carcinoma (BioChain, CDP-064004B; A503387, A503383). Sample 22 is lung squamous cell carcinoma pooled (BioChain, CDP-064004B; A411075). Samples 23-26 and sample 31 are lung squamous cell carcinoma obtained from patients. Sample 27 is lung squamous cell carcinoma (Clontech, 64013-1). Sample 28 is lung squamous cell carcinoma (BioChain, A409017). Sample 29 is lung moderately differentiated squamous cell carcinoma (BioChain, CDP-064004B; A409091). Sample 30 is lung well differentiated squamous cell carcinoma (BioChain, CDP-064004B; A408175). Samples 32-35 are lung small cell carcinoma (BioChain, CDP-064004D; A504115, A501390, A501389, A501391). Sample 36-37 are lung large cell carcinoma (BioChain, CDP-064004C; A504113, A504114). Sample 38 is lung moderately differentiated alveolus cell carcinoma (BioChain, A409089). Sample 39 is lung carcinoma obtained from patient. Sample 40 is lung H1299 non-small cell carcinoma cell line. Sample 41 is normal salivary gland sample (Clontech, 64110-1). Copy number was normalized to the levels of expression of the housekeeping genes Proteasome 26S subunit (dark columns) and GADPH (bright columns).

Real-time PCR analysis indicates that SEQ ID NO: 21 is specifically expressed in small lung cell carcinoma and in adenocarcinoma (FIG. 14).

Example 20

HSGPGI—A Lung Cancer Specific Transcript

Real-time quantitative RT-PCR was used to measure the mRNA steady state levels of HSGPGI (SEQ ID NO: 32). The following primers were used GAGCCCTGTGCGCCGCT-CAGATGTG (SEQ ID NO: 33) and AGCCCAAGTTGAAT-CACCAACCAG (SEQ ID NO: 34).

Figure 12:
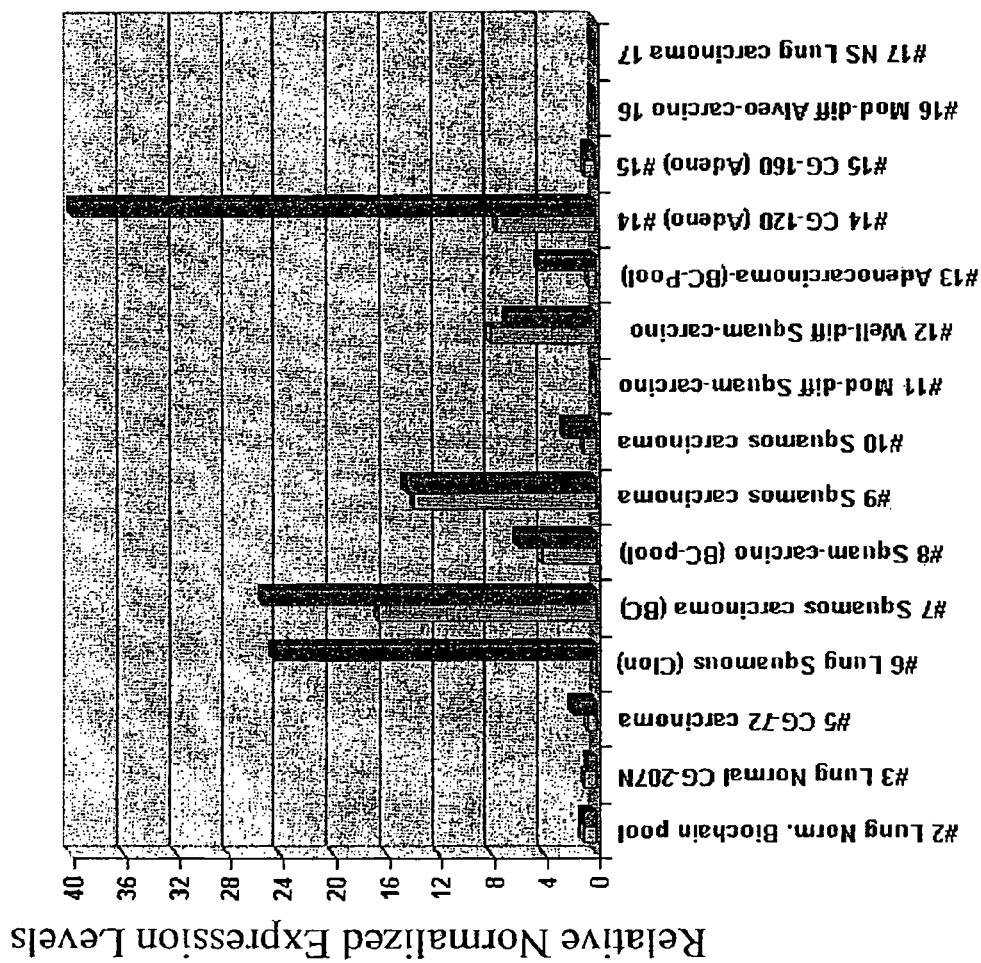
FIG. 12 is a histogram depicting Real-Time RT-PCR quantification of copy number, of the lung specific transcript (SEQ ID NO: 32). Amplification products obtained from the following tissues and cell-lines were quantified; lung normal from pooled adult total RNA (BioChain, cat no: A409363); lung tumor squamos cell carcinoma (Clontech, cat no: 64013-1); lung tumor squamos cell carcinoma (BioChain, cat no: A409017); pooled lung tumor squamos cell carcinoma (BioChain, cat no: A411075); moderately differentiated squamos cell carcinoma (BioChain, cat no: A409091); well differentiated squamos cell carcinoma (BioChain, cat no: A408175); pooled adenocarcinoma (BioChain, cat no: A411076); moderately differentiated alveolus cell carcinoma (BioChain, cat no: A409089); non-small cell lung carcinoma cell line H1299; The following normal and tumor samples were obtained from patients: normal lung (internal number-CG-207N), lung carcinoma (internal number-CG-72), squamos cell carcinoma (internal number-CG-196), squamos cell carcinoma (internal number-CG-207), lung adenocarcinoma (internal number-CG-120), lung adenocarcinoma (internal number-CG-160). Copy number was normalized to the levels of expression of the housekeeping genes Proteasome 26S subunit (dark columns) and GADPH (bright columns).

As shown in FIG. 12, real-time PCR analysis exhibited specific expression of SEQ ID NO: 32 in lung adenocarcinoma and lung squamos cell carcinoma, as compared to the expression in normal lung tissue (2-25 fold).

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims. All publications, patents, patent applications and sequences identified by their accession numbers mentioned in this specification are herein incorporated in their entirety by reference into the specification, to the same extent as if each individual publication, patent, patent application or sequence identified by their accession number was specifically and individually indicated to be incorporated herein by reference. In addition, citation or identification of any reference in this application shall not be construed as an admission that such reference is available as prior art to the present invention.

CD-ROM Content

The following lists the file content of the three CD-ROMs which are enclosed herewith and filed with the application. The content of the CD-ROMs is incorporated-by-reference in it's entirety as if fully set forth by reference herein. File information is provided as: File name/bite size/date of creation/operating system/machine format.

CD-ROM1 (1 file):
1. Transcripts_nucleotide_seqs_part1/594,305,024 bytes/Sep. 4, 2002/ASCII file/PC.

CD-ROM2 (4 files):
1. ProDG_seqs/405,504 bytes/Sep. 9, 2002/ASCII file/PC.
2. Protein.seqs/97,839,104 bytes/Sep. 9, 2002/ASCII file/PC.
3. Transcripts_nucleotide_seqs_part2/132,372,480 bytes/Sep. 9, 2002/ASCII file/PC.
4. Transcripts_nucleotide_seqs_part3/27,709,440 bytes/Sep. 11, 2002/ASCII file/PC.

CD-ROM3 (1 file):
1. Summary_table/583,723,008 bytes/Sep. 11, 2002/ASCII file/PC.

CD-ROM4 (1 file):
1. Pat11_US8_Patentin-part1/626,038,784 bytes/Oct. 24, 2006/text file/PC.

CD-ROM5 (1 file):
1. Pat11_US8_Patentin-part2/622,206,976 bytes/Oct. 24, 2006/text file/PC.

CD-ROM6 (1 file):
1. Pat11_US8_Patentin-part3/604,655,616 bytes/Oct. 24, 2006/text file/PC.

SEQUENCE LISTING (1034312 sequences)

SEQ ID NO: 1 - DNA, 348 bp, Homo sapiens
gtggttattacagcatggttcccagccttacagtgtctaagtgcttctcttgtgtcctgtagatgttgtgaaaaagaaaaaaacaaaaaatacaccacactgtactttttccccctgcccccgttactgccggtgattattattaaaaattagtttttttcacatcattatatctggcttcctataaacaacagccttaattcagtcaagactccctttggggaattcattttattaaaaattggtgtctggatacttccctgtacatgcataaatatgcatgcatgtacagaaagactgtatgtgtgtgccttgcacacacacccatacctctcagaaaaagtgttt

SEQ ID NO: 2 - DNA, 132 bp, Homo sapiens
cagaaagcccagagtagtccctgtaagaagctgaggggcgcatacctctggggtttgggttcccttcagggaagcgaagggagatgacctctttccaggctggggaccaagagggctccctagaagatatta

SEQ ID NO: 3 - DNA, 114 bp, Homo sapiens
gtagtataaccgggctctgtgattccagaggacatttagctggaaggtaccggcatggcacaggtcaccccctccctaccccatacttcctgctgagaaccagtgggtcacagg

SEQ ID NO: 4 - DNA, 10453 bp, Homo sapiens
ccctccctctcacatttccaactcccaaggataacttgtcgctcgcttcagacgcccatggcttctttcagcccctgggactcagctttctcctctacctcttttgtctatttgtgcatttgatgtttctctgggcgcgcccttggatctgcttctctcttgccttttatattctcatattctcatattctctctctctctctctctctctctctccctccctccctccctccctctctccctccctctctccctctctgcctctctccctctctctctcttctctctctctctctcttctctctctcttctctctctctctgctctctccggccatctgggcgctgctcctccgcgcctctggcctccccgcggcgcgccaggcccatctcctcaccagccgctctgggatccgacggcgccgtgggtgggggcaggtgagacggccgagccccgcccgggcggaggcaggaagcgctcgcgccaatccccctcccggaccctgtcctcgcccgccactcaccggcgccaggggaacgcaggagcgtgagccccttcgcgcccccagcgccgtcggcgtcgctgccccagacacagacactgcctcgagaggcctcacagaggcgggggcagaaggcggcgacccagagccgccacatcccccgccttgggcgccgtcacagtccccagacgccctggactcctgcagtctacgaagacgcgcgggggacggcgtggttccgagaggtaggtgaggaggcgggcgcagcccttcctctcgcagctggggactgcggcgtgaaaggcccctctccaagctgggcagccccgtggcccgagctttcaggaccaaccgcccgtggcaggcgtgggcttcccggggccaccggcttaaccttgatctccagaccgaggcagcttcccgggtagggcctcggggcgcacccgaaaacgccttggcctccctgtccgctcgcacccgaccctacctctccaacaggtgtgtgtgtggggaaagggggtcgcctcccctcgttctaccggaaaccctggctccccagagccgagtgctcagtgccccgcccagcctgaggccctgcgtcctgggcctcctgctcacaaccccggattccaggcggatgccgtgagagaggcaagggccagacgccctgagcagccttgggggtgaggaatcgcttgggatggaagaagggccacttttcctaacggaaattaggaattggcctggaactcttggtctagacagaagcccccagctccccaaggtgcagaatcagctctcccgcgcgctgtctctctagctgcctcctggcgtggagggggcagaatacttgggggagtctcttgctttggcttttgggggcctcataggttttcttcccctctggactgtgagcagcctcctgcctgagagagcgtgtatctgaatctaaggaatgccaggagacgccatcttatttgaaacccacactcacaaaaacggggcatgtgcatttttgtggagggacctgttgtttatgggagtgggcagagggcatccaaaggatttcaaactgtatggactgactcatgggtcaatacaaaaattattcgcctttgaaaaggcatgtaaagaaaagcaagcataaaggggtgtgcatcgtgcatcgtgggtattgtggagtctgagaggaattagtaactcgccggagtcggctaggaatcttatatgacagcaactgtgcctctcggagtagtcaagcaccgtttaaagattgaggatttatacagacatgcgaaagagatgtgaaattatgtgctcccaactgtgctcaataataaaggcagtagaagggaaattcatattttcatctatatgcctcccccctcgcaaagtagaacattgcatggtatatttcacatagtccacataccagaggcggaatgtgcaactgactgcccaggactgtgctttccagtacaaatggaagcacaaagatgcctaatggagaagagttaagtgaaagttctcttttctcagtgcacttccctaaccctttgaggaagcaagtctggggggcctttcctgataggatcttccctccaaatcccttttggagctggagctcctctctttccctaaagtctggcgcacttggctccaagtccccatttctccagtccagaagggatgaagcctcctccaccccaaacatatagcctttggctcgctgggaggagaattgctcaccttctgcggtggtttagaacaccaccctacacagggatacacatacacagtgccccagaggaaatgcaaagaaaggttttgctagtccaagcaaggtgttgtgggagacctcagagacccttagaaagagcctcactccccacactgcaacttgaaagacccaggacatccctcccacccccaggacagacagggttctcaccagctgggaacgcacagagcccgtgacaacaggaggatctgttgggctgggaacttcacatcccacccaccctgcctccaacttctttttttttctggccagattaaaagtcaagcttaaagtgctgttgggttagagagtttcattgttttagtctattggtttctctccctcattttcttctccctcatctcccttttactcccaggttttgcccattttttttctctctctccacacagaaaatctgtgaattttctgggcttgaacggaaggaatgaggagggaaaggagggaatatttgacctatccaggcagcactcagagctgtaattgacaccaagtcatcctagtagaccttgtcctcacaggcttagaggatatttgattccagaatcccccaccagcaccccaagatccagtggtacctccttcctccttggggcttctatagttttcaaaaatgggagaaatcaaaaatgccatcattattccagtgaccgggtgtggagggagtctgcagtttggccagaggcctggtctcagagaaaggagtcctgagggctggggggttggggcaaggcctagggccaacttggttctgaccttgcctgccagtagagaatcttgggctcttcaccaagtaaaggcaagatcaagggactggaggtctgagtccctctcttgcctaactgccccaagggccccagaaactactctgggccaaaaatcagtaatagttgaaagaaagaaacaaatactgaaaacacccagatttataatctgcttagacacccaaactcatccttaaagcagtaaataaaatttatctccttgactgccttgcaactttctactcagtttggcaatgtgtagatggggtcagcttgagtttcagagcttgggggtccagcactaaatgtctagagagctagatctggggcctctcaccccctttcctcatatacctcctcttgcttccttcccctcccagggcttctcagaaagtgacagctgacttccttttagaactgtgaaatcccacaatttcagaggatttcaaattccttgaacttcaggttgagagctatttggattaatcagagaagtttgtgtctggaaaatgatgccagatttagccagaaaactgaaagaccaaatgctttactttttttttcctttgtctgatctcagtgcttatcaggtcaaccttcacctttaaaaacaccctggtggcagtatttctttgccatcactgtctgtaaagcaaagggcaagcatctcagggcttttagttgggccgggaattcaaatgtctcctttctcaagaagatgccaaagtggccaccctcagcccactttccgtccttacctcctctgccctttccccagctgtagttataggaataatggcctttaacttgcagagatcattaaggccaaagccctcactccttcccatctctcctcttggggccgtctgagtcgcttcctccacgaccctcctcttttgaagcactccctagtactgttaaaggccgaatttgggctggagcgaagatgggggctcagtccaaaataacctagatattaagtaatagtaatgatttttttaaaaggtaactatgaactctcaagcctcgaccacccagtaaagttcctccttaaattgttgccggccctgggtgcagacacgcaaggactggccagaacgcgagaaacttcttcaaggagagagaagtcagggcccaaattcctcatgctttaaagcagtataagaggagagagtccaaatttttactcgttaaacctcctcttacctcttcctcaggtctgttcactccttggtccagggaccggagctcctgggcttcgaggtgaaccagagggaacgtggctccccgcagcaacctttttgcttcagggctcctcctgggggctgagtggtcccctttgctttgctattcccgctgcggctcctggggggacagctccgtgggaccaggtctctcagggggtggagggtcgccgaagtcgtgaccaggagttggagaccgctgcgtccctccgctgcggacctgcttgggactgcgtggaatggaccaagtcctccgtctaggattccctagtgctcgacggcgcgcactccgcagtgctccgctggagatctgcacctgtgtcccggggctgggcgcagagtgaagatctccgtgcacgctgctgaccggctcggcgactgcctccctgctgtgagcaggagaacaggaagtctgcccgacagggaggtggccgggcgggagcggcagagtcggcgttgagaggagggtcagctgcacctcgggattccgcgcgccttcaactccctcttgcggacagcccagccgcgggttggcgccgcagtgatggaacctggggagggcctagcttagagtcccagcagtccagaggaggggaccagagcagaggattaggaacggggctttcatatccagcctaggcgcccagaagcggcacttaaggggcgaagggaggccgcaattacaaaggtgcgccctccgacgcctcaacgtcaagggcctgtagattcacaacctcctctgtcggggatgggggaagatgaggtgggatagggaggctatgtccagccaccagcgcagggagtggctctaaacgctgacccaacgcctcgccccaagcgggatcttggcgcgcagatagaccgagcccgtggtggggcgccatgccgggctccctcgcccttaccgagtgagcatcttcttcccaatttgctgctcagagagggagtgggtcctagtctctggatctcagcgctcacgactacctcgctgctcctaacgaacagttcatctgctctctcctggccgcctgcgccagcgccgctcacccacttttccagccctggatctcctctccccggatgcgtccttccttcccacaattaacaaatgatctagcgaaaccccgccaggtccccggcagagaagcacctccatccgccctaaccaaccaattaatcagatcattaaggagcctgaggagttgtaattgggtggtttgggacgagggggcgctgaggaggtcattaacctccccgtaaagatggggaacggagacgcgcctggccgcctctgccgcccctgccgcccctgccgcccctgtgggctcttcttagcacgcgggttttggccactccacctgcctgctgcgctccagttcccgcctccagtccagctatttcacttctctctttgtcattctccgtcttttctctggcaaccgtccagggcccctttctttgtgcctacttctgtctacctgtccagctgcctcttgcaccctttttgtggcccagcggccaagaaaactcaaaggtcatggctgttggcccccgctgatgatctctgggctcccgggtctcagacaattcctcagggctggctagaaatggtgggagctggagatttggacactatacccattccccaagagaagggcatttgcaaaggggaagtttcctgaaacgttcaattctctttcggtatgagatagctttggacaaggtgacaaatggcggaaggtccaggccccagtggataaaagctccatattaatttaattagagacacagagaccttgcatactccttgtctgcacaggcaaatatggaggaggtagtgattgggtgttgtggcctgactggtctcagtctaagagtccccagcacctgtgacctggttcctggtgttccaagaagtccaggtgacagtatctgttcaaccttgtggaacaataaattgtttgtccttttaatttgtcttgtcagatccccaagtatattacaatgcctccctctgcattacatttttggttggttgtgtaagaatggtggatgagaggttcttaacattttggggccactccctgatatgataatttaaattttgatgaacaatattgattcccctctacccagaaaaaaaatgtgcgtatgtagtactcaccaaatcccacaatttcagagagtttcagactcctcagacaccaagttaacaactacaatttggatagatcaaaggagctggtgtctgggaaatgccgaggccaaatatagtcagtttacgtaggtcttcaccctttctcttggctgacatctccattttgccaggccagccttcacctgtaaaaacactccggtggcagtgtcctctccccaccattacctgtagggtctgggctcccagtgggagtcagtctttccttcccagcagctgggagcctgagaacgtgggaagagctttgctggggaaagctgatcttagactggccagcagttggaccagcaatggaaggaaatcaggcttaagcagcttcccagggactaaaaaccataccagaactcctggaagggaagactatctggaaacagcctcctaactaaagctgcctataagtcaagcaaatggggactgggcaatagaatgttcctttgtgtcccttattgactcacttattccatttcctcagggacccagctctacttggggctgatttagccaaggttagaggctggggaataccaaatgctgaacttaaaggggaaggatttgctccctaatattttagtaatcttgtttgtaagagataaacagcatgtgacccctgactatcctgggggacctcctaattacgcccagcctcttgtgttgtggcctgtttagacacagagtgtaaagaaggacttagctcttctttcccggcctattaagtttcctggccatctccccacatgtgtgaattgaccaagctagatctcccaggagaaaaatcaggcttctttggggtctgggaagtaaaaagaaacttcctttttcaaggactatgttaagacaaattaggagaactggaaattatctggctaattgtaccctccccctccatacatacttacactccaaacccaagccctcctggctgctcctcaattgtctatacatttcaaacaaatgtgacttggcacaggaaagactccaactcatttctagttgcccctctctgtgctgcacaaccaccacccacctgcccagcagttcgaggctgtgacaagaagccaatggttggctaatagtattcagacccctgcctgaaaatacaaagaaaaaaataaacaattctcttcttgggacagcttaaactggataatcttggctgtgaaaacctgacctaaatgcttttaatcagagcagaagaaatatatgctcatttgctccctactttactaattaaagaaagctaattggtgttctcagaaacttccaactgagggtcaggagcctctagccatctctttgcctgccccacccctccctgcactgggccatctgcaccatggagttggcctttttctgatagacaattagaagggggtgctcccgaccttctggctccgcccctgcactaggacttggccctgaaaaggcagtgctgctattggccagaagttcttgcccagcaggcttgtcttccttcttgtgtcctggacttgtttctaggagccaagacctcttgctggctgccacatcggcactgccaaccggtggggtgcagccctgctgaagccccagagctcagcccagtgctgggcacatagtaggcgctcaggaaatgattgctgaatgtggaatgaaagtccccagcagacaaaaggctgtgacttctgttagtggggtggtggtcctctggggcgagtgtatggagaacttcaaggcctcctcctggctgcccaggaagtaggtaagacctgatttttgtcaagcgtttcttagatgttttgtttaattccagcttcctggccccctatttcttgtctacccattttctaaggcaggaccgtgctcaccacagcaaagggaaataactccttgaaaagccaaaggaatacaagccaccacttctcagacctttcccctatgagatccagatactacaggctaaagggagtttgaacctgaaatgagccagataattgccccaattctctgtaccttattgaagaggtagttacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaataacactcttgaatggtctggaaactgctggcccctcagtcctgccgtcctcccagagggaaatcctaatagaagaagtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttccacgccgaggaagaccgaccggcccctaggtttatcctctgggagcccccggcccaatcagcccccttcaggccttgggagtcaccccgagtcttatcttctgtccccttccagcaagtacccggcaataaacgggcagggctgggcaaaggtctggccgctagaaacggaaaaggaaagagaaaagtaaagttaaa

SEQ ID NO: 5 - DNA, 24 bp, Homo sapiens
gtgacagccagtagctgccatctc

SEQ ID NO: 6 - DNA, 24 bp, Homo sapiens
tccgtttctagcggccagaccttt

SEQ ID NO: 7 - DNA, 1302 bp, Homo sapiens
aacgtgtgcagtgaaagatgccagacgcaaagccacggggtagaggattccttcactatggaaaatccggagcaggcaaatccatggagacagaaagcagaggaggaggtcgaggctcagagaggcgaggggggcctacccaaggccatgtcattgagagaatgaggagccaggatccaaagaaggcaggctggatgctacctcctgggaagactccatgggccatggggacaatcggggacatttgtggctgagcccctgcaggtccggggcctcagagcacggaattaactgcatcctcagctcaccggctccctgtcaacagccctcctcccacacccaacgcacagacacaggaaaaggaagggtcgcagagctcctagtgagctgggggcagagacggaagccttccacgctgtacacgccacggcctggcccatggcacagaggagcagcctggggtctgagaagtcacacagcagagttagagccaagtctgagccagtgccagctctgcaccctttccagtgatggcacagccgcgtggccaggggcagccggcaccctcactcacagttcgggccactcataaagtatgagagtcaacagccaaacccttacattttaaggacgctccatgttctggaacaatccacccatggtggaggggcagggctggagggcctgtgtcttcaggctctgaggaacaccacggggccgtcaagtggacggagcaaatgtgcctgccggtgctcaggcctgtcccaggctcgtggccaaagccatggaggtgacagattccagcctgagattctctcttcctggctgtgtgactcaggccctgtgtcacgtgctggggttcagtgtccccgtgtataagatggagaggactgtccctccctctcaggctggggtagtataaccgggctctgtgattccagaggacatttagctggaaggtaccggcatggcacaggtcaccccctccctaccccatacttcctgctgagaaccagtgggtcacaggcggccatcgatgggctgatggagtcaaaaattagaagtgtcctcattccctgtgtcacctcctgttgtcattcccattctctcatagtgactggggcgtcccagtcatcggtacagtggccacatcctcccaattgccacccgaggagtgcctgaaacctcggccgctggttgttccagtgggcgcacggctccccaggcaggcggaagtcccaccctcgcccgcgtggggctcatgatggctcggatttcaaaatatatgagcaactgaaagac

SEQ ID NO: 8 - DNA, 20 bp, Homo sapiens
gaaggcaggcggatgctacc

SEQ ID NO: 9 - DNA, 23 bp, Homo sapiens
agccttccacgctgtacacgcca

SEQ ID NO: 10 - DNA, 21 bp, Homo sapiens
gaaggcaggctggatgctacc

SEQ ID NO: 11 - DNA, 21 bp, Homo sapiens
ggtagtataaccgggctctgt

SEQ ID NO: 12 - DNA, 4128 bp, Homo sapiens
tgagaatatgagaatataaaaggcaagagagaagcagatccaagggcgcgcccagagaaacatcaaatgcacaaatagacaaaagaggtagaggagaaagctgagtcccaggggctgaaagaagccatgggcgtctgaagcgagcgacaagttatccttgggagttggaaatgtgagagggaggggcgaggccgaaggaggctgagaaggggagggggcgctcacaccctgggcgggaggcgactgatccacacttagggctccgaatccggagaaagagagcgccggaccctcctccgcccacctcccgccccagccgcagcccagcgacttcccgccatcctcggccaccgagcggctcctgcctggggttgttccaccgggatggctgcaccaggctgaaggtgcaagcttaaagtgttgctgccagacctttcttctcttctaatttaccaagtgaagaatgttgaaatatccaactataatttgtggatttctcctttcaatgctatcatttttggtgcttcatgtatttttgaagctctattattagcctctcttgaaccttcacagtccagccgagctgccatctcttcaaggaagttttccctgaagccctcaggtagacccgtttttccatggcggccacatcagcatgcagcacatttaattggaagtctccacatatgagttggttttccttacttaaaatatgcttatcatcccttggaggtattgactgctgcctcatgaaggctggtcctgtctctatagtgaatattgtgcacctcagggtagaatggagagcagaagacttcaaatcaggcagtctgggttcagaccccaattctagtgctaaatagctacgtgactttaggccgattgtgtgtgacttccctgagccccagtctctttgcctgcaaaatgagaaaaattataacaatgtcatcggttgttctgaggattctgagaggaattagtaggagagagaaataagaagctgcgggcctctacagagccattcaactggcatttcggaagatgttgcccatcagagtcagaccttcttagcatcttccggctgggcccaaacttcccaagaccatttggacaaggtcatctctatcccaccatggcctcctcccagaggaggagaagaatcatgctgttacagcagaaccgaagatttgggcaagggagctaatgattatgttctgcgtcaggtcagagatgggctgggaaagccactccaaagccaagacaagcagtttcctggaaaaagaaggctgcgcggagcccagagtggcctggatcctgcctcatttcctggaccagctccttaggtggttactggattgccaataaagcagagcttattaaagtcaacgagctcaggcttcatcgccgccatggtatccaagcaccagtctgtctgggatttcatttgccagatggacaaaggagaggttgttccaatacatatcctgagtggtgggggtggggagagaaggggaagaatgctctctagagaattctctttgtcctctgaagtaaatagagatcatgtcttccccagccacactcagtgatctgaatctcttggactgtggatttttcctttacctgctgtgaagccttgaaaagtatgaattagcttgataatgatcctctaaagatgttcaagagttaaagacgtgtttaagttcttcaggcaatccaatatgactacgggtttccaaaaatttgaaggaaactgaaaatcatagttcccaaaccagatattttccggtgtccagatgttcactggcatgcaaaccaaatgtctggattatgagctccttttttcatttctttttatcagcttacatccagatgttggatccaactggtcagaggcctggggcagagacagaaatcaaatctagggtgttcatctagagtctcctgctcctccattcctgcttcctcctcacgctgcccccacatcctccccaactcaccttcatgctacatctcggcaaatacagctcatatccaggcacggtgcagcccttgacagctgggtccgcaaaggcagatcgggtatatctttaaagaaaagttatcttaaccattgagaagccttccttcctcagaggagagcacctccccagcagacctccgaggagaccaagggcaggacaggaagggtgaaaggaagtttcaggactgcaggaaataagagcttggaggtcaagggagagatcagataaaacatgaatctgatcagcatcctagtggtctagagtggagacaatctgcggagtcaacctcagtaaggacacacatagagaagaaccaaagcctctaaagacgaagctgagaagtgtacggtcgtagaagactcgtgtctgttattcttaaaagctcaaggaggtataaactgcataagatttaaatggaggaacacacgatcttacttgctttcagaggattttggggtccccattctcccactagcagccaggcaactctctctgtcctctccaaagggaggagtggaaaggcttcaaaatccctaggaaataaatgtcccctccacccaaagtccagtgtgtagcctgaggacaggactttcactgagagaaatatataaaagaaggggatagaagccaggcacccaggtggtgggtaacagaagggaactttctagctggttttatttagggagggcatcctgggcaaaagtcagaatgcaactttttttttaaaccccttttaacaagatgctgttgaattcctcttttgcagatgttctgccaattgaatggaaactgtccatagtggggagcagagagcctcatcttttctggaactgaacatccatccttaaggccagatttctcccatcaccaactttaactcctgccctagccctctctcttccttttcaaaaccctctccacccaggaagggagattctggagccaagactgtaccagccacacctccccagagttgttaaggaaggaactcgaagccaggggtggtcctctggcaagcacccccactaccagtagcaggacagatgtgtttctaatggactacactatccccggaggtcacatgattcaggctgccaagggtacctgcccttgggaaatcaactcccgaagataaattgggattgggtcctgagaagatccatggaagcccagaggaccctgcctctctctgttgcttcatgctgtagaggcagtactggggagggcctgccccacatccggcggggcagctggaaccatgtgtttgatgacactctgctccctcaatgtggagcctcatcctcatctcacagtctagcaggcctctggtgggttaggcttgtctcacccagtgtgtgagtttttttggaagtgacctgattttggagtttccctccaagcctttctcaggtacatgctttctcttttattctgtcttctttttttgatcttcttaaatctggttttctcctttttccctctcttgtctccatcttttttccagtctctcgcttctctttatttctccccatatttcactctgttctctcaccccaacctttcccttctgtttctctccctccctctcttcccaccccctgcctggccttccatatatcaagcagagttttatcaccttatgcaggggcagccctgccacctgccataaagttgataggctaatgacattttgtggatattgccatgtcacaagtccaggacagcatcaaaaatagccctgatgtctaaaccacttcagctatcttttttatttttaaaataaatacattcacatgcttttaagaaactataaaaatatataaagtaaaaagatctttctctcacactgtctccacctctcctggtctcaccgttgtgcttaggggaaaccattgtgattagtttctcctgtgtccttccagagtgtctttatgcaaatgaaaattattgtgataatatattcctattttcccccttactacacaaaagatagactaccataatcccattctgcacttttttttcacttgataataaaaacatgattttattaatgggtgtttatggagtgattaccatgtgctatgtgcctgctgggcactgc

SEQ ID NO: 13 - DNA, 24 bp, Homo sapiens
catatttcactctgttctctcacc

SEQ ID NO: 14 - DNA, 26 bp, Homo sapiens
cagaatgggattatggtagtctatct

SEQ ID NO: 15 - DNA, 600 bp, Homo sapiens
cagagttggtccgaccagccttggaaaggtcactgaaaaatcttcaattggattatgttgacctctaccttattcattttccagtgtctgtaaagccaggtgaggaagtgatcccaaaagatgaaaatggaaaaatactatttgacacagtggatctctgtgccacgtgggaggccatggagaagtgtaaagatgcaggattggccaagtccatcggggtgtccaacttcaaccacaggcagctggagatgatcctcaacaagccagggctcaagtacaagcctgtctgcaaccaggtggaatgtcatccttacttcaaccagagaaaactgctggatttctgcaagtcaaaagacattgttctggttgcctatagtgctctgggatcccaccgagaagaaccatgggtggacccgaactccccggtgctcttggaggacccagtcctttgtgccttggcaaaaaagcacaagcgaaccccagccctgattgccctgcgctaccagctacagcgtggggttgtggtcctggccaagagctacaatgagcagcgcatcagacagaacgtgcaggtgtttgaattccagttgacttcagagg

SEQ ID NO: 16 - DNA, 27 bp, Homo sapiens
cttcaattggattatgttgacctctac

SEQ ID NO: 17 - DNA, 25 bp, Homo sapiens
cactataggcaaccagaacaatgtc

SEQ ID NO: 18 - DNA, 527 bp, Homo sapiens
gctggaggggcgaggaccgggtataagaagcctcgtggccttgcccgggcagccgcaggttccccgcgcgccccgagcccccgcgccatgaagctcgccgccctcctggggctctgcgtggccctgtcctgcagctccgctgctgctttcttagtgggctcggccaagcctgtggcccagcctgtcgctgcgctggagtcggcggcggaggccggggccgggaccctggccaaccccctcggcaccctcaacccgctgaagctcctgctgagcagcctgggcatccccgtgaaccacctcatagagggctcccagaagtgtgtggctgagctgggtccccaggccgtgggggccgtgaaggccctgaaggccctgctgggggccctgacagtgtttggctgagccgagactggagcatctacacctgaggacaagacgctgcccacccgcgagggctgaaaaccccgccgcggggaggaccgtccatccccttcccccggcccctctcaataaacgtggttaagagc

SEQ ID NO: 19 - DNA, 22 bp, Homo sapiens
gcgaggaccgggtataagaagc

SEQ ID NO: 20 - DNA, 23 bp, Homo sapiens
tcggctcagccaaacactgtcag

SEQ ID NO: 21 - DNA, 1417 bp, Homo sapiens
gggcggaggcccctcgaggtgacacccaccactcagccgagcgggactacgagtctgctttgtgctccgcgaggaccagaaacacctgcaagaggcacggagaggaggcgcctttcaagaggcgcctttcatggaactgaggactggcctggcttggggacaccaacaagccttccccctcctgctggacacagagacacccacccagcacaccagacacaccctctgagtcacctaggccgcctggggctgagaagacctaaccgaggggccagatggcttcgaccggcttagaactgctgggcatgaccctggctgtgctgggctggctggggaccctggtgtcctgcgccctgcccctgtggaaggtgaccgccttcatcggcaacagcatcgtggtggcccaggtggtgtgggagggcctgtggatgtcctgcgtggtgcagagcacgggccagatgcagtgcaaggtgtacgactcactgctggctctgccgcaggacctgcaggccgcacgtgccctctgtgtcattgccctcctgctggccctgcttggcctcctggtggccatcacaggtgcccagtgtaccacgtgtgtggaggacgaaggtgccaaggcccgtatcgtgctcaccgcgggggtcatcctcctcctcgccggcatcctggtgctcatccctgtgtgctggacggcgcacgccatcatccaggacttctacaaccccctggtggctgaggccctcaagcgggagctgggggcctccctctacctgggctgggcggcggctgcactgcttatgctgggcggggggctcctctgctgcacgtgccccccgccccaggtcgagcggccccgcggacctcggctgggctactccatcccctcccgctcgggtgcatctggactggacaagagggactacgtgtgaggcggaggtttcccctgggagcccactgctccccactgccccgccctttcgaccttggcctgatgaccagatgccctgctccatcacaacctccttccccaggaaaacccactttccaaaagcccaagctacacctggctgcagggctgggtcagctggcctggctgagctcttctcagtggggtcccctttgatgttctcccccaagttgggcagcctagaggtgttgggaaccctggcctgcccccacctccccagtaattgtttccttccgttgcccaggacactggctggccttccttctcttctgagccctcccctgccccaggaaccctggcctcaccaaaacagcagcagctcgttggctccaaaaccagggagcagaccatgccctcccaaccctggagttgtcagggagggcctgcccatcacctccctctccccaacatccccaccctcgagttggaaataaagagcatttgtaactg

SEQ ID NO: 22 - DNA, 20 bp, Homo sapiens
gcttcgaccggcttagaact

SEQ ID NO: 23 - DNA, 18 bp, Homo sapiens
ggtgagcacgatacgggc

SEQ ID NO: 24 - DNA, 10618 bp, Homo sapiens
  misc_feature (9466)..(9466): n is a, c, g, or t
ccctccctctcacatttccaactcccaaggataacttgtcgctcgcttcagacgcccatggcttctttcagcccctgggactcagctttctcctctacctcttttgtctatttgtgcatttgatgtttctctgggcgcgcccttggatctgcttctctcttgccttttatattctcatattctcatattctctctctctctctctctctctctctccctccctccctccctccctctctccctccctctctccctctctgcctctctccctctctctctcttctctctctctctctcttctctctctcttctctctctctctgctctctccggccatctgggcgctgctcctccgcgcctctggcctccccgcggcgcgccaggcccatctcctcaccagccgctctgggatccgacggcgccgtgggtgggggcaggtgagacggccgagccccgcccgggcggaggcaggaagcgctcgcgccaatccccctcccggaccctgtcctcgcccgccactcaccggcgccaggggaacgcaggagcgtgagccccttcgcgcccccagcgccgtcggcgtcgctgccccagacacagacactgcctcgagaggcctcacagaggcgggggcagaaggcggcgacccagagccgccacatcccccgccttgggcgccgtcacagtccccagacgccctggactcctgcagtctacgaagacgcgcgggggacggcgtggttccgagaggtaggtgaggaggcgggcgcagcccttcctctcgcagctggggactgcggcgtgaaaggcccctctccaagctgggcagccccgtggcccgagctttcaggaccaaccgcccgtggcaggcgtgggcttcccggggccaccggcttaaccttgatctccagaccgaggcagcttcccgggtagggcctcggggcgcacccgaaaacgccttggcctccctgtccgctcgcacccgaccctacctctccaacaggtgtgtgtgtggggaaagggggtcgcctcccctcgttctaccggaaaccctggctccccagagccgagtgctcagtgccccgcccagcctgaggccctgcgtcctgggcctcctgctcacaaccccggattccaggcggatgccgtgagagaggcaagggccagacgccctgagcagccttgggggtgaggaatcgcttgggatggaagaagggccacttttcctaacggaaattaggaattggcctggaactcttggtctagacagaagcccccagctccccaaggtgcagaatcagctctcccgcgcgctgtctctctagctgcctcctggcgtggagggggcagaatacttgggggagtctcttgctttggcttttgggggcctcataggttttcttcccctctggactgtgagcagcctcctgcctgagagagcgtgtatctgaatctaaggaatgccaggagacgccatcttatttgaaacccacactcacaaaaacggggcatgtgcatttttgtggagggacctgttgtttatgggagtgggcagagggcatccaaaggatttcaaactgtatggactgactcatgggtcaatacaaaaattattcgcctttgaaaaggcatgtaaagaaaagcaagcataaaggggtgtgcatcgtgcatcgtgggtattgtggagtctgagaggaattagtaactcgccggagtcggctaggaatcttatatgacagcaactgtgcctctcggagtagtcaagcaccgtttaaagattgaggatttatacagacatgcgaaagagatgtgaaattatgtgctcccaactgtgctcaataataaaggcagtagaagggaaattcatattttcatctatatgcctcccccctcgcaaagtagaacattgcatggtatatttcacatagtccacataccagaggcggaatgtgcaactgactgcccaggactgtgctttccagtacaaatggaagcacaaagatgcctaatggagaagagttaagtgaaagttctcttttctcagtgcacttccctaaccctttgaggaagcaagtctggggggcctttcctgataggatcttccctccaaatcccttttggagctggagctcctctctttccctaaagtctggcgcacttggctccaagtccccatttctccagtccagaagggatgaagcctcctccaccccaaacatatagcctttggctcgctgggaggagaattgctcaccttctgcggtggtttagaacaccaccctacacagggatacacatacacagtgccccagaggaaatgcaaagaaaggttttgctagtccaagcaaggtgttgtgggagacctcagagacccttagaaagagcctcactccccacactgcaacttgaaagacccaggacatccctcccacccccaggacagacagggttctcaccagctgggaacgcacagagcccgtgacaacaggaggatctgttgggctgggaacttcacatcccacccaccctgcctccaacttctttttttttctggccagattaaaagtcaagcttaaagtgctgttgggttagagagtttcattgttttagtctattggtttctctccctcattttcttctccctcatctcccttttactcccaggttttgcccattttttttctctctctccacacagaaaatctgtgaattttctgggcttgaacggaaggaatgaggagggaaaggagggaatatttgacctatccaggcagcactcagagctgtaattgacaccaagtcatcctagtagaccttgtcctcacaggcttagaggatatttgattccagaatcccccaccagcaccccaagatccagtggtacctccttcctccttggggcttctatagttttcaaaaatgggagaaatcaaaaatgccatcattattccagtgaccgggtgtggagggagtctgcagtttggccagaggcctggtctcagagaaaggagtcctgagggctggggggttggggcaaggcctagggccaacttggttctgaccttgcctgccagtagagaatcttgggctcttcaccaagtaaaggcaagatcaagggactggaggtctgagtccctctcttgcctaactgccccaagggccccagaaactactctgggccaaaaatcagtaatagttgaaagaaagaaacaaatactgaaaacacccagatttataatctgcttagacacccaaactcatccttaaagcagtaaataaaatttatctccttgactgccttgcaactttctactcagtttggcaatgtgtagatggggtcagcttgagtttcagagcttgggggtccagcactaaatgtctagagagctagatctggggcctctcaccccctttcctcatatacctcctcttgcttccttcccctcccagggcttctcagaaagtgacagctgacttccttttagaactgtgaaatcccacaatttcagaggatttcaaattccttgaacttcaggttgagagctatttggattaatcagagaagtttgtgtctggaaaatgatgccagatttagccagaaaactgaaagaccaaatgctttactttttttttcctttgtctgatctcagtgcttatcaggtcaaccttcacctttaaaaacaccctggtggcagtatttctttgccatcactgtctgtaaagcaaagggcaagcatctcagggcttttagttgggccgggaattcaaatgtctcctttctcaagaagatgccaaagtggccaccctcagcccactttccgtccttacctcctctgccctttccccagctgtagttataggaataatggcctttaacttgcagagatcattaaggccaaagccctcactccttcccatctctcctcttggggccgtctgagtcgcttcctccacgaccctcctcttttgaagcactccctagtactgttaaaggccgaatttgggctggagcgaagatgggggctcagtccaaaataacctagatattaagtaatagtaatgatttttttaaaaggtaactatgaactctcaagcctcgaccacccagtaaagttcctccttaaattgttgccggccctgggtgcagacacgcaaggactggccagaacgcgagaaacttcttcaaggagagagaagtcagggcccaaattcctcatgctttaaagcagtataagaggagagagtccaaatttttactcgttaaacctcctcttacctcttcctcaggtctgttcactccttggtccagggaccggagctcctgggcttcgaggtgaaccagagggaacgtggctccccgcagcaacctttttgcttcagggctcctcctgggggctgagtggtcccctttgctttgctattcccgctgcggctcctggggggacagctccgtgggaccaggtctctcagggggtggagggtcgccgaagtcgtgaccaggagttggagaccgctgcgtccctccgctgcggacctgcttgggactgcgtggaatggaccaagtcctccgtctaggattccctagtgctcgacggcgcgcactccgcagtgctccgctggagatctgcacctgtgtcccggggctgggcgcagagtgaagatctccgtgcacgctgctgaccggctcggcgactgcctccctgctgtgagcaggagaacaggaagtctgcccgacagggaggtggccgggcgggagcggcagagtcggcgttgagaggagggtcagctgcacctcgggattccgcgcgccttcaactccctcttgcggacagcccagccgcgggttggcgccgcagtgatggaacctggggagggcctagcttagagtcccagcagtccagaggaggggaccagagcagaggattaggaacggggctttcatatccagcctaggcgcccagaagcggcacttaaggggcgaagggaggccgcaattacaaaggtgcgccctccgacgcctcaacgtcaagggcctgtagattcacaacctcctctgtcggggatgggggaagatgaggtgggatagggaggctatgtccagccaccagcgcagggagtggctctaaacgctgacccaacgcctcgccccaagcgggatcttggcgcgcagatagaccgagcccgtggtggggcgccatgccgggctccctcgcccttaccgagtgagcatcttcttcccaatttgctgctcagagagggagtgggtcctagtctctggatctcagcgctcacgactacctcgctgctcctaacgaacagttcatctgctctctcctggccgcctgcgccagcgccgctcacccacttttccagccctggatctcctctccccggatgcgtccttccttcccacaattaacaaatgatctagcgaaaccccgccaggtccccggcagagaagcacctccatccgccctaaccaaccaattaatcagatcattaaggagcctgaggagttgtaattgggtggtttgggacgagggggcgctgaggaggtcattaacctccccgtaaagatggggaacggagacgcgcctggccgcctctgccgcccctgccgcccctgccgcccctgtgggctcttcttagcacgcgggttttggccactccacctgcctgctgcgctccagttcccgcctccagtccagctatttcacttctctctttgtcattctccgtcttttctctggcaaccgtccagggcccctttctttgtgcctacttctgtctacctgtccagctgcctcttgcaccctttttgtggcccagcggccaagaaaactcaaaggtcatggctgttggcccccgctgatgatctctgggctcccgggtctcagacaattcctcagggctggctagaaatggtgggagctggagatttggacactatacccattccccaagagaagggcatttgcaaaggggaagtttcctgaaacgttcaattctctttcggtatgagatagctttggacaaggtgacaaatggcggaaggtccaggccccagtggataaaagctccatattaatttaattagagacacagagaccttgcatactccttgtctgcacaggcaaatatggaggaggtagtgattgggtgttgtggcctgactggtctcagtctaagagtccccagcacctgtgacctggttcctggtgttccaagaagtccaggtgacagtatctgttcaaccttgtggaacaataaattgtttgtccttttaatttgtcttgtcagatccccaagtatattacaatgcctccctctgcattacatttttggttggttgtgtaagaatggtggatgagaggttcttaacattttggggccactccctgatatgataatttaaattttgatgaacaatattgattcccctctacccagaaaaaaaatgtgcgtatgtagtactcaccaaatcccacaatttcagagagtttcagactcctcagacaccaagttaacaactacaatttggatagatcaaaggagctggtgtctgggaaatgccgaggccaaatatagtcagtttacgtaggtcttcaccctttctcttggctgacatctccattttgccaggccagccttcacctgtaaaaacactccggtggcagtgtcctctccccaccattacctgtagggtctgggctcccagtgggagtcagtctttccttcccagcagctgggagcctgagaacgtgggaagagctttgctggggaaagctgatcttagactggccagcagttggaccagcaatggaaggaaatcaggcttaagcagcttcccagggactaaaaaccataccagaactcctggaagggaagactatctggaaacagcctcctaactaaagctgcctataagtcaagcaaatggggactgggcaatagaatgttcctttgtgtcccttattgactcacttattccatttcctcagggacccagctctacttggggctgatttagccaaggttagaggctggggaataccaaatgctgaacttaaaggggaaggatttgctccctaatattttagtaatcttgtttgtaagagataaacagcatgtgacccctgactatcctgggggacctcctaattacgcccagcctcttgtgttgtggcctgtttagacacagagtgtaaagaaggacttagctcttctttcccggcctattaagtttcctggccatctccccacatgtgtgaattgaccaagctagatctcccaggagaaaaatcaggcttctttggggtctgggaagtaaaaagaaacttcctttttcaaggactatgttaagacaaattaggagaactggaaattatctggctaattgtaccctccccctccatacatacttacactccaaacccaagccctcctggctgctcctcaattgtctatacatttcaaacaaatgtgacttggcacaggaaagactccaactcatttctagttgcccctctctgtgctgcacaaccaccacccacctgcccagcagttcgaggctgtgacaagaagccaatggttggctaatagtattcagacccctgcctgaaaatacaaagaaaaaaataaacaattctcttcttgggacagcttaaactggataatcttggctgtgaaaacctgacctaaatgcttttaatcagagcagaagaaatatatgctcatttgctccctactttactaattaaagaaagctaattggtgttctcagaaacttccaactgagggtcaggagcctctagccatctctttgcctgccccacccctccctgcactgggccatctgcaccatggagttggcctttttctgatagacaattagaagggggtgctcccgaccttctggctccgcccctgcactaggacttggccctgaaaaggcagtgctgctattggccagaagttcttgcccagcaggcttgtcttccttcttgtgtcctggacttgtttctaggagccaagacctcttgctggctgccacatcggcactgccaaccggtggggtgcagccctgctgaagccccagagctcagcccagtgctgggcacatagtaggcgctcaggaaatgattgctgaatgtggaatgaaagtccccagcagacaaaaggctgtgacttctgttagtggggtggtggtcctctggggcgagtgtatggagaacttcaaggcctcctcctggctgcccaggaagtaggtaagacctgatttttgtcaagcgtttcttagatgttttgtttaattccagcttcctggccccctatttcttgtctacccattttctaaggcaggaccgtgctcaccacagcaaagggaaataactccttgaaaagccaaaggaatacaagccaccacttctcagacctttcccctatgagatccagatactacaggctaaagggagtttgaacctgaaatgagccagataattgccccaattctctgtaccttattgaagaggtagttacaggccaaggggtccaaggggcctcacttttatagacattgctctaagtcaaaagaatacattatacatatacagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggcttcggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaatancactcttgaatggtctggaaactgctggcccctcagtcctgccgtcctcccagagggaaatcctaatagaagaagtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttccacgccgaggaagaccgaccggcccctaggtttatcctctgggagcccccggcccaatcagcccccttcaggccttgggagtcaccccgagtcttatcttctgtccccttccagcaagtacccggcaataaacgggcagggctgggcaaaggtctggccgctagaaacggaaaaggaaagagaaaagtaaagttaaa

SEQ ID NO: 25 - DNA, 10512 bp, Homo sapiens
ccctccctctcacatttccaactcccaaggataacttgtcgctcgcttcagacgcccatggcttctttcagcccctgggactcagctttctcctctacctcttttgtctatttgtgcatttgatgtttctctgggcgcgcccttggatctgcttctctcttgccttttatattctcatattctcatattctctctctctctctctctctctctctccctccctccctccctccctctctccctccctctctccctctctgcctctctccctctctctctcttctctctctctctctcttctctctctcttctctctctctctgctctctccggccatctgggcgctgctcctccgcgcctctggcctccccgcggcgcgccaggcccatctcctcaccagccgctctgggatccgacggcgccgtgggtgggggcaggtgagacggccgagccccgcccgggcggaggcaggaagcgctcgcgccaatccccctcccggaccctgtcctcgcccgccactcaccggcgccaggggaacgcaggagcgtgagccccttcgcgcccccagcgccgtcggcgtcgctgccccagacacagacactgcctcgagaggcctcacagaggcgggggcagaaggcggcgacccagagccgccacatcccccgccttgggcgccgtcacagtccccagacgccctggactcctgcagtctacgaagacgcgcgggggacggcgtggttccgagaggtaggtgaggaggcgggcgcagcccttcctctcgcagctggggactgcggcgtgaaaggcccctctccaagctgggcagccccgtggcccgagctttcaggaccaaccgcccgtggcaggcgtgggcttcccggggccaccggcttaaccttgatctccagaccgaggcagcttcccgggtagggcctcggggcgcacccgaaaacgccttggcctccctgtccgctcgcacccgaccctacctctccaacaggtgtgtgtgtggggaaagggggtcgcctcccctcgttctaccggaaaccctggctccccagagccgagtgctcagtgccccgcccagcctgaggccctgcgtcctgggcctcctgctcacaaccccggattccaggcggatgccgtgagagaggcaagggccagacgccctgagcagccttgggggtgaggaatcgcttgggatggaagaagggccacttttcctaacggaaattaggaattggcctggaactcttggtctagacagaagcccccagctccccaaggtgcagaatcagctctcccgcgcgctgtctctctagctgcctcctggcgtggagggggcagaatacttgggggagtctcttgctttggcttttgggggcctcataggttttcttcccctctggactgtgagcagcctcctgcctgagagagcgtgtatctgaatctaaggaatgccaggagacgccatcttatttgaaacccacactcacaaaaacggggcatgtgcatttttgtggagggacctgttgtttatgggagtgggcagagggcatccaaaggatttcaaactgtatggactgactcatgggtcaatacaaaaattattcgcctttgaaaaggcatgtaaagaaaagcaagcataaaggggtgtgcatcgtgcatcgtgggtattgtggagtctgagaggaattagtaactcgccggagtcggctaggaatcttatatgacagcaactgtgcctctcggagtagtcaagcaccgtttaaagattgaggatttatacagacatgcgaaagagatgtgaaattatgtgctcccaactgtgctcaataataaaggcagtagaagggaaattcatattttcatctatatgcctcccccctcgcaaagtagaacattgcatggtatatttcacatagtccacataccagaggcggaatgtgcaactgactgcccaggactgtgctttccagtacaaatggaagcacaaagatgcctaatggagaagagttaagtgaaagttctcttttctcagtgcacttccctaaccctttgaggaagcaagtctggggggcctttcctgataggatcttccctccaaatcccttttggagctggagctcctctctttccctaaagtctggcgcacttggctccaagtccccatttctccagtccagaagggatgaagcctcctccaccccaaacatatagcctttggctcgctgggaggagaattgctcaccttctgcggtggtttagaacaccaccctacacagggatacacatacacagtgccccagaggaaatgcaaagaaaggttttgctagtccaagcaaggtgttgtgggagacctcagagacccttagaaagagcctcactccccacactgcaacttgaaagacccaggacatccctcccacccccaggacagacagggttctcaccagctgggaacgcacagagcccgtgacaacaggaggatctgttgggctgggaacttcacatcccacccaccctgcctccaacttctttttttttctggccagattaaaagtcaagcttaaagtgctgttgggttagagagtttcattgttttagtctattggtttctctccctcattttcttctccctcatctcccttttactcccaggttttgcccattttttttctctctctccacacagaaaatctgtgaattttctgggcttgaacggaaggaatgaggagggaaaggagggaatatttgacctatccaggcagcactcagagctgtaattgacaccaagtcatcctagtagaccttgtcctcacaggcttagaggatatttgattccagaatcccccaccagcaccccaagatccagtggtacctccttcctccttggggcttctatagttttcaaaaatgggagaaatcaaaaatgccatcattattccagtgaccgggtgtggagggagtctgcagtttggccagaggcctggtctcagagaaaggagtcctgagggctggggggttggggcaaggcctagggccaacttggttctgaccttgcctgccagtagagaatcttgggctcttcaccaagtaaaggcaagatcaagggactggaggtctgagtccctctcttgcctaactgccccaagggccccagaaactactctgggccaaaaatcagtaatagttgaaagaaagaaacaaatactgaaaacacccagatttataatctgcttagacacccaaactcatccttaaagcagtaaataaaatttatctccttgactgccttgcaactttctactcagtttggcaatgtgtagatggggtcagcttgagtttcagagcttgggggtccagcactaaatgtctagagagctagatctggggcctctcaccccctttcctcatatacctcctcttgcttccttcccctcccagggcttctcagaaagtgacagctgacttccttttagaactgtgaaatcccacaatttcagaggatttcaaattccttgaacttcaggttgagagctatttggattaatcagagaagtttgtgtctggaaaatgatgccagatttagccagaaaactgaaagaccaaatgctttactttttttttcctttgtctgatctcagtgcttatcaggtcaaccttcacctttaaaaacaccctggtggcagtatttctttgccatcactgtctgtaaagcaaagggcaagcatctcagggcttttagttgggccgggaattcaaatgtctcctttctcaagaagatgccaaagtggccaccctcagcccactttccgtccttacctcctctgccctttccccagctgtagttataggaataatggcctttaacttgcagagatcattaaggccaaagccctcactccttcccatctctcctcttggggccgtctgagtcgcttcctccacgaccctcctcttttgaagcactccctagtactgttaaaggccgaatttgggctggagcgaagatgggggctcagtccaaaataacctagatattaagtaatagtaatgatttttttaaaaggtaactatgaactctcaagcctcgaccacccagtaaagttcctccttaaattgttgccggccctgggtgcagacacgcaaggactggccagaacgcgagaaacttcttcaaggagagagaagtcagggcccaaattcctcatgctttaaagcagtataagaggagagagtccaaatttttactcgttaaacctcctcttacctcttcctcaggtctgttcactccttggtccagggaccggagctcctgggcttcgaggtgaaccagagggaacgtggctccccgcagcaacctttttgcttcagggctcctcctgggggctgagtggtcccctttgctttgctattcccgctgcggctcctggggggacagctccgtgggaccaggtctctcagggggtggagggtcgccgaagtcgtgaccaggagttggagaccgctgcgtccctccgctgcggacctgcttgggactgcgtggaatggaccaagtcctccgtctaggattccctagtgctcgacggcgcgcactccgcagtgctccgctggagatctgcacctgtgtcccggggctgggcgcagagtgaagatctccgtgcacgctgctgaccggctcggcgactgcctccctgctgtgagcaggagaacaggaagtctgcccgacagggaggtggccgggcgggagcggcagagtcggcgttgagaggagggtcagctgcacctcgggattccgcgcgccttcaactccctcttgcggacagcccagccgcgggttggcgccgcagtgatggaacctggggagggcctagcttagagtcccagcagtccagaggaggggaccagagcagaggattaggaacggggctttcatatccagcctaggcgcccagaagcggcacttaaggggcgaagggaggccgcaattacaaaggtgcgccctccgacgcctcaacgtcaagggcctgtagattcacaacctcctctgtcggggatgggggaagatgaggtgggatagggaggctatgtccagccaccagcgcagggagtggctctaaacgctgacccaacgcctcgccccaagcgggatcttggcgcgcagatagaccgagcccgtggtggggcgccatgccgggctccctcgcccttaccgagtgagcatcttcttcccaatttgctgctcagagagggagtgggtcctagtctctggatctcagcgctcacgactacctcgctgctcctaacgaacagttcatctgctctctcctggccgcctgcgccagcgccgctcacccacttttccagccctggatctcctctccccggatgcgtccttccttcccacaattaacaaatgatctagcgaaaccccgccaggtccccggcagagaagcacctccatccgccctaaccaaccaattaatcagatcattaaggagcctgaggagttgtaattgggtggtttgggacgagggggcgctgaggaggtcattaacctccccgtaaagatggggaacggagacgcgcctggccgcctctgccgcccctgccgcccctgccgcccctgtgggctcttcttagcacgcgggttttggccactccacctgcctgctgcgctccagttcccgcctccagtccagctatttcacttctctctttgtcattctccgtcttttctctggcaaccgtccagggcccctttctttgtgcctacttctgtctacctgtccagctgcctcttgcaccctttttgtggcccagcggccaagaaaactcaaaggtcatggctgttggcccccgctgatgatctctgggctcccgggtctcagacaattcctcagggctggctagaaatggtgggagctggagatttggacactatacccattccccaagagaagggcatttgcaaaggggaagtttcctgaaacgttcaattctctttcggtatgagatagctttggacaaggtgacaaatggcggaaggtccaggccccagtggataaaagctccatattaatttaattagagacacagagaccttgcatactccttgtctgcacaggcaaatatggaggaggtagtgattgggtgttgtggcctgactggtctcagtctaagagtccccagcacctgtgacctggttcctggtgttccaagaagtccaggtgacagtatctgttcaaccttgtggaacaataaattgtttgtccttttaatttgtcttgtcagatccccaagtatattacaatgcctccctctgcattacatttttggttggttgtgtaagaatggtggatgagaggttcttaacattttggggccactccctgatatgataatttaaattttgatgaacaatattgattcccctctacccagaaaaaaaatgtgcgtatgtagtactcaccaaatcccacaatttcagagagtttcagactcctcagacaccaagttaacaactacaatttggatagatcaaaggagctggtgtctgggaaatgccgaggccaaatatagtcagtttacgtaggtcttcaccctttctcttggctgacatctccattttgccaggccagccttcacctgtaaaaacactccggtggcagtgtcctctccccaccattacctgtagggtctgggctcccagtgggagtcagtctttccttcccagcagctgggagcctgagaacgtgggaagagctttgctggggaaagctgatcttagactggccagcagttggaccagcaatggaaggaaatcaggcttaagcagcttcccagggactaaaaaccataccagaactcctggaagggaagactatctggaaacagcctcctaactaaagctgcctataagtcaagcaaatggggactgggcaatagaatgttcctttgtgtcccttattgactcacttattccatttcctcagggacccagctctacttggggctgatttagccaaggttagaggctggggaataccaaatgctgaacttaaaggggaaggatttgctccctaatattttagtaatcttgtttgtaagagataaacagcatgtgacccctgactatcctgggggacctcctaattacgcccagcctcttgtgttgtggcctgtttagacacagagtgtaaagaaggacttagctcttctttcccggcctattaagtttcctggccatctccccacatgtgtgaattgaccaagctagatctcccaggagaaaaatcaggcttctttggggtctgggaagtaaaaagaaacttcctttttcaaggactatgttaagacaaattaggagaactggaaattatctggctaattgtaccctccccctccatacatacttacactccaaacccaagccctcctggctgctcctcaattgtctatacatttcaaacaaatgtgacttggcacaggaaagactccaactcatttctagttgcccctctctgtgctgcacaaccaccacccacctgcccagcagttcgaggctgtgacaagaagccaatggttggctaatagtattcagacccctgcctgaaaatacaaagaaaaaaataaacaattctcttcttgggacagcttaaactggataatcttggctgtgaaaacctgacctaaatgcttttaatcagagcagaagaaatatatgctcatttgctccctactttactaattaaagaaagctaattggtgttctcagaaacttccaactgagggtcaggagcctctagccatctctttgcctgccccacccctccctgcactgggccatctgcaccatggagttggcctttttctgatagacaattagaagggggtgctcccgaccttctggctccgcccctgcactaggacttggccctgaaaaggcagtgctgctattggccagaagttcttgcccagcaggcttgtcttccttcttgtgtcctggacttgtttctaggagccaagacctcttgctggctgccacatcggcactgccaaccggtggggtgcagccctgctgaagccccagagctcagcccagtgctgggcacatagtaggcgctcaggaaatgattgctgaatgtggaatgaaagtccccagcagacaaaaggctgtgacttctgttagtggggtggtggtcctctggggcgagtgtatggagaacttcaaggcctcctcctggctgcccaggaagtagagggcgccaaaggcgacgtgccggccgccagctccaggccgagccccgagcgcctgcaggaacaggccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaaaaaaaaatccagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaataacactcttgaatggtctggaaactgctggcccctcagtcctgccgtcctcccagagggaaatcctaatagaagaagtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttccacgccgaggaagaccgaccggcccctaggtttatcctctgggagcccccggcccaatcagcccccttcaggccttgggagtcaccccgagtcttatcttctgtccccttccagcaagtacccggcaataaacgggcagggctgggcaaaggtctggccgctagaaacggaaaaggaaagagaaaagtaaagttaaa

SEQ ID NO: 26 - DNA, 2399 bp, Homo sapiens
ctcctcctggctgcccaggaagtagtgtcttcttttgcaagctgggggaggggtttaaagatgctggcgctgccctctagccggctgctggggacatcaaaggagattcgggctgtggaaggctccctagcgtcggagatggagttaggagagggcgccaaaggcgacgtgccggccgccagctccaggccgagccccgagcgcctgcaggaacaggccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaaaaaaaaatccagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaataacactcttgaatggtctggaaactgctggcccctcagtcctgccgtcctcccagagggaaatcctaatagaagaagtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttccacgccgaggaagaccgaccggcccctaggtttatcctctgggagcccccggcccaatcagcccccttcaggccttgggagtcaccccgagtcttatcttctgtccccttccagcaagtacccggcaataaacgggcagggctgggcaaaggtctggccgctagaaacggaaaaggaaagagaaaagtaaagttaaa

SEQ ID NO: 27 - DNA, 2490 bp, Homo sapiens
ctcctggctgcccaggaagtagtgtcttcttttgcaagctgggggaggggtttaaagatgctggcgctgccctctagccggctgctggggacatcaaaggagattcgggctgtggaaggctccctagcgtcggagatggagttaggaggtaagggccagggggtgggagcggatggggccttgattagctgtggatttctgtcccagcgcactcatttaaccgtgtttctcttggttggcagagggcgccaaaggcgacgtgccggccgccagctccaggccgagccccgagcgcctgcaggaacaggccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaaaaaaaaatccagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaataacactcttgaatggtctggaaactgctggcccctcagtcctgccgtcctcccagagggaaatcctaatagaagaagtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttccacgccgaggaagaccgaccggcccctaggtttatcctctgggagcccccggcccaatcagcccccttcaggccttgggagtcaccccgagtcttatcttctgtccccttccagcaagtacccggcaataaacgggcagggctgggcaaaggtctggccgctagaaacggaaaaggaaagagaaaagtaaagttaaa

SEQ ID NO: 28 - DNA, 2995 bp, Homo sapiens
ccctccctctcacatttccaactcccaaggataacttgtcgctcgcttcagacgcccatggcttctttcagcccctgggactcagctttctcctctacctcttttgtctatttgtgcatttgatgtttctctgggcgcgcccttggatctgcttctctcttgccttttatattctcatattctcatattctctctctctctctctctctctctctccctccctccctccctccctctctccctccctctctccctctctgcctctctccctctctctctcttctctctctctctctcttctctctctcttctctctctctctgctctctccggccatctgggcgctgctcctccgcgcctctggcctccccgcggcgcgccaggcccatctcctcaccagccgctctgggatccgacggcgccgtgggtgggggcaggtgagacggccgagccccgcccgggcggaggcaggaagcgctcgcgccaatccccctcccggaccctgtcctcgcccgccactcaccggcgccaggggaacgcaggagcgtgagccccttcgcgcccccagcgccgtcggcgtcgctgccccagacacagacactgcctcgagaggcctcacagaggcgggggcagaaggcggcgacccagagccgccacatcccccgccttgggcgccgtcacagtccccagacgccctggactcctgcagtctacgaagacgcgcgggggacggcgtggttccgagagagggcgccaaaggcgacgtgccggccgccagctccaggccgagccccgagcgcctgcaggaacaggccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaaaaaaaaatccagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagagtctaagactataaaaggtttccatctccttttctcagccagggagccacagagacccaggccagcagtaggctgggagccagcacaccggcccccaccaggtgcccggtaggggatgggtaataacactcttgaatggtctggaaactgctggcccctcagtcctgccgtcctcccagagggaaatcctaatagaagaagtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttccacgccgaggaagaccgaccggcccctaggtttatcctctgggagcccccggcccaatcagcccccttcaggccttgggagtcaccccgagtcttatcttctgtccccttccagcaagtacccggcaataaacgggcagggctgggcaaaggtctggccgctagaaacggaaaaggaaagagaaaagtaaagttaaa

SEQ ID NO: 29 - DNA, 3753 bp, Homo sapiens
  misc_feature (1005)..(1005): n is a, c, g, or t
tgagaatatgagaatataaaaggcaagagagaagcagatccaagggcgcgcccagagaaacatcaaatgcacaaatagacaaaagaggtagaggagaaagctgagtcccaggggctgaaagaagccatgggcgtctgaagcgagcgacaagttatccttgggagttggaaatgtgagagggaggggcgaggccgaaggaggctgagaaggggagggggcgctcacaccctgggcgggaggcgactgatccacacttagggctccgaatccggagaaagagagcgccggaccctcctccgcccacctcccgccccagccgcagcccagcgacttcccgccatcctcggccaccgagcggctcctgcctggggttgttccaccgggatggctgcaccaggctgaaggtgcaagcttaaagtgttgctgccagacctttcttctcttctaatttaccaagtgaagaatgttgaaatatccaactataatttgtggatttctcctttcaatgctatcatttttggtgcttcatgtatttttgaagctctattattagcctctcttgaaccttcacagtccagccgagctgccatctcttcaaggaagttttccctgaagccctcaggtagacccgtttttccatggcggccacatcagcatgcagcacatttaattggaagtctccacatatgagttggttttccttacttaaaatatgcttatcatcccttggaggtattgactgctgcctcatgaaggctggtcctgtctctatagtgaatattgtgcacctcagggtagaatggagagcagaagacttcaaatcaggcagtctgggttcagaccccaattctagtgctaaatagctacgtgactttaggccgattgtgtgtgacttccctgagccccagtctctttgcctgcaaaatgagaaaaattataacaatgtcatcggttgttctgaggattctgagaggaattagtaggagagagaactaagaagctgcnggcctctacagagccattcaactggcatttcggaagatgttgcccatcagagtcagaccttcttagcatcttccggctgggcccaaacttcccaagaccatttggacaaggtcatctctatcccaccatggcctcctcccagaggaggagaagaatcatgctgttacagcagaaccgaagatttgggcaagggagctaatgattatgttctgcgtcaggtcagagatgggctgggaaagccactccaaagccaagacaagcagtttcctggaaaaagaaggctgcgcggagcccagagtggcctggatcctgcctcatttcctggaccagctccttaggtggttactggattgccaataaagcagagcttattaaagtcaacgagctcaggcttcatcgccgccatggtatccaagcaccagtctgtctgggatttcatttgccagatggacaaaggagaggttgttccaatacatatcctgagtggtgggggtggggagagaaggggaagaatgctctctagagaattctctttgtcctctgaagtaaatagagatcatgtcttccccagccacactcagtgatctgaatctcttggactgtggatttttcctttacctgctgtgaagccttgaaaagtatgaattagcttgataatgatcctctaaagatgttcaagagttaaagacgtgtttaagttcttcaggcaatccaatatgactacgggtttccaaaaatttgaaggaaactgaaaatcatagttcccaaaccagatattttccggtgtccagatgttcactggcatgcaaaccaaatgtctggattatgagctccttttttcatttctttttatcagcttacatccagatgttggatccaactggtcagaggcctggggcagagacagaaatcaaatctagggtgttcatctagagtctcctgctcctccattcctgcttcctcctcacgctgcccccacatcctccccaactcaccttcatgctacatctcggcaaatacagctcatatccaggcacggtgcagcccttgacagctgggtccgcaaaggcagatcgggtatatctttaaagaaaagttatcttaaccattgagaagccttccttcctcagaggagagcacctccccagcagacctccgaggagaccaagggcaggacaggaagggtgaaaggaagtttcaggactgcaggaaataagagcttggaggtcaagggagagatcagataaaacatgaatctgatcagcatcctagtggtctagagtggagacaatctgcggagtcaacctcagtaaggacacacatagagaagaaccaaagcctctaaagacgaagctgagaagtgtacggtcgtagaagactcgtgtctgttattcttaaaagctcaaggagatgttctgccaattgaatggaaactgtccatagtggggagcagagagcctcatcttttctggaactgaacatccatccttaaggccagatttctcccatcaccaactttaactcctgccctagccctctctcttccttttcaaaaccctctccacccaggaagggagattctggagccaagactgtaccagccacacctccccagagttgttaaggaaggaactcgaagccaggggtggtcctctggcaagcacccccactaccagtagcaggacagatgtgtttctaatggactacactatccccggaggtcacatgattcaggctgccaagggtacctgcccttgggaaatcaactcccgaagataaattgggattgggtcctgagaagatccatggaagcccagaggaccctgcctctctctgttgcttcatgctgtagaggcagtactggggagggcctgccccacatccggcggggcagctggaaccatgtgtttgatgacactctgctccctcaatgtggagcctcatcctcatctcacagtctagcaggcctctggtgggttaggcttgtctcacccagtgtgtgagtttttttggaagtgacctgattttggagtttccctccaagcctttctcaggtacatgctttctcttttattctgtcttctttttttgatcttcttaaatctggttttctcctttttccctctcttgtctccatcttttttccagtctctcgcttctctttatttctccccatatttcactctgttctctcaccccaacctttcccttctgtttctctccctccctctcttcccaccccctgcctggccttccatatatcaagcagagttttatcaccttatgcaggggcagccctgccacctgccataaagttgataggctaatgacattttgtggatattgccatgtcacaagtccaggacagcatcaaaaatagccctgatgtctaaaccacttcagctatcttttttatttttaaaataaatacattcacatgcttttaagaaactataaaaatatataaagtaaaaagatctttctctcacactgtctccacctctcctggtctcaccgttgtgcttaggggaaaccattgtgattagtttctcctgtgtccttccagagtgtctttatgcaaatgaaaattattgtgataatatattcctattttcccccttactacacaaaagatagactaccataatcccattctgcacttttttttcacttgataataaaaacatgattttattaatgggtgtttatggagtgattaccatgtgctatgtgcctgctgggcactgc

SEQ ID NO: 30 - DNA, 3260 bp, Homo sapiens
  misc_feature (1005)..(1005): n is a, c, g, or t
tgagaatatgagaatataaaaggcaagagagaagcagatccaagggcgcgcccagagaaacatcaaatgcacaaatagacaaaagaggtagaggagaaagctgagtcccaggggctgaaagaagccatgggcgtctgaagcgagcgacaagttatccttgggagttggaaatgtgagagggaggggcgaggccgaaggaggctgagaaggggagggggcgctcacaccctgggcgggaggcgactgatccacacttagggctccgaatccggagaaagagagcgccggaccctcctccgcccacctcccgccccagccgcagcccagcgacttcccgccatcctcggccaccgagcggctcctgcctggggttgttccaccgggatggctgcaccaggctgaaggtgcaagcttaaagtgttgctgccagacctttcttctcttctaatttaccaagtgaagaatgttgaaatatccaactataatttgtggatttctcctttcaatgctatcatttttggtgcttcatgtatttttgaagctctattattagcctctcttgaaccttcacagtccagccgagctgccatctcttcaaggaagttttccctgaagccctcaggtagacccgtttttccatggcggccacatcagcatgcagcacatttaattggaagtctccacatatgagttggttttccttacttaaaatatgcttatcatcccttggaggtattgactgctgcctcatgaaggctggtcctgtctctatagtgaatattgtgcacctcagggtagaatggagagcagaagacttcaaatcaggcagtctgggttcagaccccaattctagtgctaaatagctacgtgactttaggccgattgtgtgtgacttccctgagccccagtctctttgcctgcaaaatgagaaaaattataacaatgtcatcggttgttctgaggattctgagaggaattagtaggagagagaactaagaagctgcnggcctctacagagccattcaactggcatttcggaagatgttgcccatcagagtcagaccttcttagcatcttccggctgggcccaaacttcccaagaccatttggacaaggtcatctctatcccaccatggcctcctcccagaggaggagaagaatcatgctgttacagcagaaccgaagatttgggcaagggagctaatgattatgttctgcgtcaggtcagagatgggctgggaaagccactccaaagccaagacaagcagtttcctggaaaaagaaggctgcgcggagcccagagtggcctggatcctgcctcatttcctggaccagctccttaggtggttactggattgccaataaagcagagcttattaaagtcaacgagctcaggctttatcgccgccatggtatccaagcaccagtctgtctgggatttcatttgccagatggacaaaggagaggttgttccaatacatatcctgagtggtgggggtggggagagaaggggaagaatgctctctagagaattctctttgtcctctgaagtaaatagagatcatgtcttccccagccacactcagtgatctgaatctcttggactgtggatttttcctttacctgctgtgaagccttgaaaagtatgaattagcttgataatgatcctctaaagatgttcaagagttaaagacgtgtttaagttcttcaggcaatccaatatgactacgggtttccaaaaatttgaaggaaactgaaaatcatagttcccaaaccagatattttccggtgtccagatgttcactggcatgcaaaccaaatgtctggattatgagctccttttttcatttctttttatcagcttacatccagatgttggatccaactggtcagaggcctggggcagagacagaaatcaaatctagggtgttcatctagagtctcctgctcctccattcctgcttcctcctcacgctgcccccacatcctccccaactcaccttcatgctacatctcggcaaatacagctcatatccaggcacggtgcagcccttgacagctgggtccgcaaaggcagatcgggaagggagattctggagccaagactgtaccagccacacctccccagagttgttaaggaaggaactcgaagccaggggtggtcttctggcaagcacccccactaccagtagcaggacagatgtgtttctaatggactacactatccccggaggtcacatgattcaggctgccaagggtacctgcccttgggaaataactcccgaagataaattgggattgggtcctgagaagatccatggaagcccagaggaccctgcctctctctgttgcttcatgctgtagaggcagtactggggagggcctgccccacatccggcggggcagctggaaccatgtgtttgatgacactctgctccctcaatgtggagcctcatcctcatctcacagtctagcaggcctctggtgggttaggcttgtctcacccagtgtgtgagtttttttggaagtgacctgattttggagtttccctccaagcctttctcaggtacatgctttctcttttattctgtcttctttttttgatcttcttaaatctggttttctcctttttccctctcttgtctccatcttttttccagtctctcgcttctctttatttctccccatatttcactctgttctctcaccccaacctttcccttctgtttctctccctccctctcttcccaccccctgcctggccttccatatatcaagcagagttttatcaccttatgcaggggcagccctgccacctgccataaagttgataggctaatgacattttgtggatattgccatgtcacaagtccaggacagcatcaaaaatagccctgatgtctaaaccacttcagctatcttttttatttttaaaataaatacattcacatgcttttaagaaactataaaaatatataaagtaaaaagatctttctctcacactgtctccacctctcctggtctcaccgttgtgcttaggggaaaccattgtgattagtttctcctgtgtccttccagagtgtctttatgcaaatgaaaattattgtgataatatattcctattttcccccttactacacaaaagatagactaccataatcccattctgcacttttttttcacttgataataaaaacatgattttattaatgggtgtttatggagtgattaccatgtgctatgtgcctgctgggcactgc

SEQ ID NO: 31 - DNA, 2932 bp, Homo sapiens
gcaagcttaaagtgttgctgccagacctttcttctcttctaatttaccaagtgaagaatgttgaaatatccaactataatttgtggatttctcctttcaatgctatcatttttggtgcttcatgtatttttgaagctctattattaggctagagtgcaatggcacgatcttggctcactgaaacctccgcctcctgggttcaagcgattctcctgtctcagcctctggagcagctgggattacaggcgcatgccaccatgcccggctaatttttgtatttttagtagggatggggtttcaccatgttggccaggctggtctcgaactcctgacctcaggtgatctgccagcctcggcctcccaaagtgctggaattacaggtgtgagtcactgggcctggtcaggatttctttcatttcaactaactgttggcttattaaccctacttttttgttttaatttttagtggttactgttattttaatgtattagtcagatttttccagaaaaacaaaacctataggagatagataggtagatagatagatagatagatagacagacagaggaggatttactataaggaattggcttgcatgattatggaggctgagaagtcccaagatctgcagttgacaagctggggacccaggagcatcagtggcataactccagtctgaatctgtgtctaaaggctggagaagatcagtgttccagctcaaaaacattcaggcagggagagccttccactactggcaggagcgcctttttgttcttgtcagttcttcaatcgattggatgtggtccacccatattagggagggcaatgtgctttactcagtctattgattcaaataatgtcatgcagaaacacccttgtagacgtacccagaataatgtttaactgaatatctggcaccccatggcctagtcaagttgacacataaaattaaccatcacatttgagatttataatttgcatctttaacttatcacggtctatctgcaaagaatattatatcacttagctgggcgtagtgctgtgtgcctatagtcccagctactcaggaggctaagtggggaggattgcttgagccctgaagttcgaggctgcagtgagctgcgatcacatcactgctctccagcctgggctacagagaaagagcttgtctctaaaaaaattaaaaataaaataaaaagaatattacctcatgtatggtgatacaatagtatacttctatttccttctcttttgtggctattgctgacatataatttatctgtagctatgagccctgcagtacattgctattatgttttgcttaaatagtaaattgtcttttaaatatattaaaatgaaataaggtgttttatatttatatgcatatttaacatttgtatactgcaggtatgctggcgacagtttcttttagcttttgtctgaaatagtcatttaaaggtaaaacattttaaaactttataatttgcaataatattatacttatgaagaattacaaaattgcccaaaaaatttccataaacctatttcccaatttcttcatacggtaacatccacaaaactaccatccaaactaaaagattgacattgatacaatactattagctcacctggagaccttattccagttttgtccattgtcctactattgtcccttttcttgaccagtattcaatctagggttgcttattgcctttaattgtcttttcttcttagtctcctttaatctgggatagttcctcaggcttcctttcttgacacttgtgctggttgtttgtggttgccctgcagagcaaagatcagcaactctacccaaatgtggtttgaatgtggagactgatgatgccacatatacacaaagagggcatgaggcattctgggcagagcacaacaggctccccaaaaggccccaaaatggcttgagaacaagggaggggcaagttgccttgggtcttattgaggttaagggctggggatagggcatggttttcccatgcacaggccagtgtttgaacttccctgctggagccaagggaggaaacacctacgcttttttgtctaccaaatggagggcaaaagattaaggaggagttgtggggcttcaaagctgtcagtggtcaaacatcaaatatggaattggattctgttacgattcacccctgatgtttaatggattactgaaatctagggaagtggagtcctacggacacagcaaaccaccacgagaatcatggagatgaataggggcaggataatttaccagaggaagcctagagtggagtgctggacagaccaccatgtggagttgccatctgaggacattgctacttggatacccccacagtccagccgagctgccatctcttcaaggaagttttccctgaagccctcaggtagacccgtttttccatggcggccacatcagcatgcagcacatttaattggaagtctccacatatgagttggttttccttacttaaaatatgcttatcatcccttggaggctggagtgcagtggcatgatcacggctcactgcagcctcaacctcccaagctcaagggattctcccacctcggactcccaagcagctggggctacaggtattgactgctgcctcatgaaggctggtcctgtctctatagtgaatattgtgcacctcagggtagaatggagagcagaagacttcaaatcaggcagtctgggttcagaccccaattctagtgctaaatagctacgtgactttaggccgattgtgtgtgacttccctgagccccagtctctttgcctgcaaaatgagaaaaattataacaatgtcatcggttgttctgaggattctgagaggaattagtaggagagagaaataagaagctgcgggcctctacagagccattcaactggcatttcggaagatg

SEQ ID NO: 32 - DNA, 600 bp, Homo sapiens
gagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaa

SEQ ID NO: 33 - DNA, 25 bp, Homo sapiens
gagccctgtgcgccgctcagatgtg

SEQ ID NO: 34 - DNA, 24 bp, Homo sapiens
agcccaagttgaatcaccaaccag

SEQ ID NO: 35 - protein, 161 aa, Homo sapiens
RAPKATCRPPAPGRAPSACRNRPLHPARDAELRENLVQRGLNARAPPRGWSLSRPHPPGDHRAASPAARRQKLEKKKKSSWGLGTRLLAPLNSPRLSPPSPPVMNPVKGDRPGSPRNIYSCDSHKMEKGLNFCFFKELVFCVCVYTASSHQPNCLAPLQLR

SEQ ID NO: 36 - protein, 97 aa, Homo sapiens
LLLAAQEVVSSFASWGRGLKMLALPSSRLLGTSKEIRAVEGSLASEMELGEGAKGDVPAASSRPSPERLQEQAPSPGAGRRAARESCSARTQRQGAA

SEQ ID NO: 37 - protein, 163 aa, Homo sapiens
LLAAQEVVSSFASWGRGLKMLALPSSRLLGTSKEIRAVEGSLASEMELGGKGQGVGADGALISCGFLSQRTHLTVFLLVGRGRQRRRAGRQLQAEPRAPAGTGPFTRRGTQSCERILFSADSTPGRRLEVGLCLGLTRRETTELLPQPPAARNWKKKKNPAGV

SEQ ID NO: 38 - protein, 96 aa, Homo sapiens
MSGTSTPAMGVCAEPLKVDLSFGEPSERHSWYLWEWLWGVLWHHTDNFVFLIGIHGLGSWDGGRGKPQSPWKCMQNIWVCRCIILRLWPLQFFQRV

SEQ ID NO: 39 - DNA, 1052 bp, Homo sapiens
gtgacagccagtagctgccatctcagtattttgaatgaaaatataacatgataaagagcaaatgagggaggctggaggggcctccccatgcaaatactggaatatgaatgttggccagaaataagatacttcctgccctccagctgttaaagagctccccaattcctcccttttggtgctaggaaggggccagagggcactgcccccagaccaccacccacctctggagagctggggccgagtgggactgcctgcagcagagttaacccttcagaaaattcaaaacctatactgcctagtattttccctgcccgtttattttttaatcagatttttaaaatatccagcagcactttggtgccttttcttggggttggggagtggggttatctatgtgtgtatctatgggaaggtgggtgccttcagtgcactaaaccccctcttgggcctgcagctggacctcactcctgtacctgaacactctgcctgagcctgagctaatcttagccatccattgtgtctcaaaactgttttggaggtgaataactgtgaggcaggatggagaaccttttgctctcccatccagaagggcacctaaccaggcccctggagcagacaaaaggagcaggaagtcaatcacttcgatcccagttctctgaagcccaagaagaaaacggattttccttcgttttggttcggaggcctagtagagaatttggattccaccaagttctcttttttcaaaaaaagtaaacggtccagagcagacaaaaactgtggaaacttgaggcctgggtagtagtggttttgtttgattttgaggctttaaagagataaggagacggtggtggagctccgccacgccgcgtggctctcacttccacgccgaggaagaccgaccggcccctaggtttatcctctgggagcccccggcccaatcagcccccttcaggccttgggagtcaccccgagtcttatcttctgtccccttccagcaagtacccggcaataaacgggcagggctgggcaaaggtctggccgctagaaacgga

SEQ ID NO: 40 - DNA, 484 bp, Homo sapiens
catatttcactctgttctctcaccccaacctttcccttctgtttctctccctccctctcttcccaccccctgcctggccttccatatatcaagcagagttttatcaccttatgcaggggcagccctgccacctgccataaagttgataggctaatgacattttgtggatattgccatgtcacaagtccaggacagcatcaaaaatagccctgatgtctaaaccacttcagctatcttttttatttttaaaataaatacattcacatgcttttaagaaactataaaaatatataaagtaaaaagatctttctctcacactgtctccacctctcctggtctcaccgttgtgcttaggggaaaccattgtgattagtttctcctgtgtccttccagagtgtctttatgcaaatgaaaattattgtgataatatattcctattttcccccttactacacaaaagatagactaccataatcccattctg

SEQ ID NO: 41 - DNA, 429 bp, Homo sapiens
tgttttagaaatctcatgattcccaggaaaaaaattttaaattgtgatacaggtttgacagccttttagtcaaataagttaaaacacacacgcaaactcatttactcactttgccattataattcaatcacaaagaaattttggccaggcgtggtggttacgcctgtaatcccagcactttgggaggccgaggcaggtggatcacgaggtcaggggatcaagatcatcctggctaacatgtgaaaccccgtctctattaaaaataaaaaattagcctggtgtggtggcgggtgcctgtagtcccagctactcgggaggctgaggcagcagaatggcgtgaactcaggaggcggagcttgcagtgagccgagatcgcgccactgcactccagcctggatgacagagcgagactccatctcaaaaaaaaaa

SEQ ID NO: 42 - DNA, 1964 bp, Homo sapiens
ttttttataaggatgaaaatccgttgcagaagattttgccttgagtcccattggctaaaactgggttccatgcctgtgccctagctgcaagggatgctgggaatctgagtatctagcacttcctcctggactgtgggaagctgactctgccagggtgacaatgggtgttcatagacagcttgcccatgtacagtggggaatggaagagtcctgtactctcctcctcaatgcctgtgtctctcccacggctgcaggtcagaggattcccagctcccaaccccgcagctagccaacccagagccaggagacaagagtaatgaacctgaagatgctgggaccagagacccagaccccactccagagggagcctggcagtcagacagcagctctggaagcagagccctggatgaagtggacgagcagctgttccgctccgtggagggccaggccgcctctgacgaggaggaggtggaggaggagaggtggcaggaggagaagaagacgccggcagccgaggccaagacactgctggcccggctctccagctgcagaggcaggtgtgatgaccagacggcggagaagctcatgacttactttggtcacttcggcggtgccaaccatgcccataccctgggggagctggaggcctgcattgccatgctggtggagcagctgaggactcaaggctgcggtgggaggaccctggggacctctgaggaggaggcagagttgcagcagaaggtggaagagaatgagcacctgaggctggagctgcagatggtagagaccgagagggtgcggctgtccctgctggaggagaagctggtggacgtgctgcagctcctgcagaggctccgggacctgaacatatcgaaaagagccctggggaagattttgctgagcacgctggacgctttcagggaccccacccacgagggaaggcccagccctgcagccatcctggatgccctgcaccaagccttggctgcctgccagctgttgcggagacagccctcggcaccagcctctgcagcagctgcgctcaccaaccccctcctcgtctcctgctgaggttactggcccaccctgtgggcaccctgctcagcctgactgcctttggaccagcctccatgatcagcccaaccactgacagctggtctgaccaccgtcacatcatcagaacttgagtctctgctggctccttccaaggttaagcccgagcccagagcctcccattgcagcacctggcagccaccccttcctcgggctcctccacattacctcgcagcccctgcattcctgccaccagagtccacattaaagccctgcagttgctggatcagcctgcacctgatgccgtatctttcccctgccctcagggcagagatgcccactttctgactgagtctgaccccaaatctcttccccagagtttcaggatctcctcccctcccagcactgtctccttcctcccactggcatgcctgctgcaacggagactgggcccaacctttgggatacctggtctgtaggaaagcactccacaccccaggaaatgttgatgactaggaaaggctgagggaattccaaggaaggaacaatcactgtaggctccctggtagaagctggccttgaaccagctctagaggacaggtaggatttagacaggtaaagaaaggagggaagggcatagaatctaaggtaatggcaagagcaaaggtgtggaaccagaggggggccccaggaatgcagtgcttggagcccctgctcctgaacacgcattaactcctgaactgcgagcccctcctcctgaactgcgtcatggggttgcaggaaggagtaggccaagatacccagtctcacctaacttagactgtcattagagagaaagatccattgccaaacagtgccatgggggtgaaaccagtgctaaatggaggtaaaataaagtttgtaagagccca

SEQ ID NO: 43 - DNA, 2059 bp, Homo sapiens
  misc_feature (967)..(967): n is a, c, g, or t
agttgtttctacattttctccaccaccgctctggtttcctggaggccttgatcttgcctgcccaggcacccctcaggaaagtcatagccctgtggctggggagggtggagtgttgtgggccatcaggaaataaactggcagtcacaaagttctgaagggcatagccaccccttttctaagaatatttaaaggaaacagggcttggaggatcctaaaattagctggccttccagtcacatccctaaagagcagaggcactgggccttccctcttcctgcccaagcccagggtggaccctgagtgccctcaggcaccacactttccactgcttctctttccctccattggtgccaggggaagggaatgcctcgtgcctggcatgcctgctttagaaggcaggggccacaaaacactttgtgactgcctggcatcctagtgttactgggtacaactgacggtttaggtggccccctggccaagagtgggcccaagactccgactgggccaaccacgcccctctcctggggctctccatgctgggggatggggatggctggagagggtctttctcggctgtggctcttggataagaggcttgggacactcccactgtctcaaccctgtcccattcctgaggttctccagctgctagtccattctgggatctgcccactagcctgccataaatttcctctctgtgtaagctagccagattggcttctgcagcttcccactaaacttaatttgtttgaaagaaacaaaaccagagaagagaagggagaatggagtccttagagtgggaaacaaaatatacaactcttacatcagtccaacccgctgtgtggctttaggccacacactcagcttctctgggcctcagcaccagcctcggggagatggagtagttgatcctgccacctggaaggctgggagaggccagcaaagtgagcactgagccccttctctncccaggcagagttgcagcagaaggtggaagagaatgagcacctgaggctggagctgcagatggtagagaccgagagggtgcggctgtccctgctggaggagaagctggtggacgtgctgcagctcctgcagaggctccgggacctggtaggctcacgggagagctgccacactcagggaagggaaaggagctcttgggagggagccccacttgtgtcaggcaccaggctctaggctctccttacagtaggcagctgttatcccattttacagatgcagaaatggaggctcagaagaaccaaccaaaaatagggttggggggctccccaggtcattttaagaagctaataaaactcttgtatgtatccttttctggttctgttctcaaaaccagaaaaggataaatggaagaaagacaagaaaggaaaattataaactaatgtgacatttaaacatggatgcaaaattattaaatacaatactagcaaaccaaatctggcagtgtttaaagaaatgcaacatgaccaagttggacttatcctacaaattcaaggatgattccacatcaaaaaatctattaccaaaatacaccacattgcagattaaaggagaaagaccaaatgatcatctcaattgatgcagaaaaggaagtcaataaaattcaatctcctttgattataaaacccctcagcaaattaagaatagtagggatcttccttcaccagataagggctctcaaccaaatacttcatgcagatctcacactgactggtgacgtgttcagaggaatccccctaaaatcagatgtggctgggcctggtggtgcatgcctgtaatcccagcactttgggaggcctaggtgggtggatcgcttgagctcaggagttcgagaccagcctggccaatatggtgaaacccccacctctacaaaaaaaaaaaaaaaattagctgggcatggtggtgtatgcctgtggtcccagctacttgggaggctgaggtgggaggattgccaaagtccaggaggcaaaagttgcagtgagctgagattgtgccactgcactccagcctgggtgacagagtaagaccttatctc

SEQ ID NO: 44 - DNA, 147 bp, Homo sapiens
gactgagtcctaatcaaaacacttccaaacatttgtccagatggatttcacaattgctttggaccagtgactcctttgaatttctcaattttctcctttttgaagagggatgtctgtagcagttatcttatgccctctcctgccact

SEQ ID NO: 45 - DNA, 429 bp, Homo sapiens; identical to SEQ ID NO: 41

SEQ ID NO: 46 - DNA, 441 bp, Homo sapiens
cttgtcattcatgtgtttacatggcccctgccatcaaacttcacctgtgtcagtcaacaccagcaaagttcaccctaggatgatcactctgcccaggaaaggattcttgcaaatcaaagcattgactggttcagaagcaggaacatctggccaccatttctagtccccaccagttccatttccagattcaaagtagccttctgtctcctgccaccctagaggacacactgggtgtgactgagtaggcaacacagcattcttggttgttaggcctctagggtcatactgtgccctctctgggccatgactcaaactaattcaattttgatgaatgaagccactatttcttataaaaccctctggaagatgattccacatgctgtaccagatacgcccatttctgaaagagctcacagttgggaagctgaagtcagtcatgaa

SEQ ID NO: 47 - DNA, 584 bp, Homo sapiens
ggagctattactactgatcttacagaaataactagggctataaaaggatactatgaacaattgtatggtaacagattagataacataaacaaaatggacaaattcctagaaacatgcatgcaaactatctaaactgactcaaggctggacgcggtggcttatgtctgtagtcccagcactttgtgaggccgaggcgggtggatcacctgaggtcaggagttcgagaccagcctggccaacatggtgaaatgctgttcctactaaaaatacaaaaattagccaggtatgctggcgtgcgcctgtagtccgagatactggggaggctgaggtgggagaatcacttgaactcgggaggtagaagttgcagtgagccaagatggcaccactgcactccagcctgggcgacagagcgagaccaaactgactcaagaagaaacagaaaatctgaatagacctataacaaataaagaatcagtagtcaaaaaacttccaatgaaagaaaagttcagaaactttcactacagttatacgttttagcttccaaaaagaaaagtcaatttcaataaggaaattgaatcaatagt

SEQ ID NO: 48 - DNA, 556 bp, Homo sapiens
gcaaataaaacagtagcttaaagtgtcaatttcaaccagaaaataacagctctgatttctcatggctcacactcttttaaaacgactcgggtagaggctgagaaaggccgtgttgtttgtctacctgggactagaaacaatcataacaagaataagaagcaagccgggtgcggtggctcatgcctgtaattccagcactttgggaggccgagctgggaggatcacttgagcccaggagtttgagaccaacctgggtaacataatgagaccttacaaaaaaaaataaaattaaatttcaaaaacataattagataccagtgtatccccagcagattgacacaaattaaaagtcaacagtatcctgtgttggtgaagacatacagcaactggaagtctcctgtgcatgttagccatgtttatacctttcatctcagcagtttcactcttaacgatatatgctagagaaactcttactcatgtgctccacagacaggtaggagggcccaaggtaaccttgtttgtaattaagaaaaaataaaaacaggaaacaagcaaa

SEQ ID NO: 49 - DNA, 389 bp, Homo sapiens
cgcaccactctttttatttttaattttttaaaacttttttagagacatggtctccctaggttgcccaggagtttgagaccaacctgggtaacataatgagaccttacaaaaaaaaataaaattaaatttcaaaaacataattagataccagtgtatccccagcagattgacacaaattaaaagtcaacagtatcctgtgttggtgaagacatacagcaactggaagtctcctgtgcatgttagccatgtttatacctttcatctcagcagtttcactcttaacgatatatgctagagaaactcttactcatgtgctccacagacaggtaggagggcccaaggtaaccttgtttgtaattaagaaaaaataaaaacaggaaacaagcaaa

SEQ ID NO: 50 - DNA, 278 bp, Homo sapiens
agaagcatccactgacctgactgttatcaccgtagcttaggtttgcctcttagagctttgtacacatgaaatcttgtgatatttatgatgtttacattttttcttgtcaacgtgctttcattctcacattagcccttgtcagaagaaatatgtgaaatacacagaagagcaggtacagcagtccccaccccccactctttttttctttttttgagacacggtctcactctgtcacccaggctggagtgcagtagtgcgatgttggctcactgcaacct

SEQ ID NO: 51 - DNA, 409 bp, Homo sapiens
gcgcctcatgtgcccaggcgtgtcaactaggcctggcttggggagaccttctcaggcagcagaagaacaacagcctgaacaataagcctggcttgaggccctggagccactcagcagcctcacattctctgtcattactctttaatcctctccacgccttgggagagaaagcaagtctgagtcacccgctcaataggtaagaaagctgtggcttgagaggttgtgacagctgcaaccacactcacacaccaaagcagcagaacccaaactggggccatggccagtctgtgtccaggggagccatctgtgtgccgtcctcccaagcacagctgacacatcctgagctcacctcttactgctggggctggtggttttgctgaagttgcttgagacgaaaagacttggaaga

SEQ ID NO: 52 - DNA, 496 bp, Homo sapiens
gggtaattaaatgggtatttataattagaacttaataatttgcatcagggacaaatgagctctgattttaatctgcagcgcatttagattagcccaaagatagtgtaatttgatggtttataggcctcctctcggattatgaaacaataccaagccttcaagtgcagtgtgtctatgtcaggagggtgttaaagaagaagatgcaatgaaaatgtttgacaacgtgaaagcagccataaattacatgacaactgtgtaaaagtcatgatgaaacaaataaagggctgacctataatgcgtctgattcattgtgacacacacaactccctgcgctaatctctgcccagccaacgcattcttaagcggggaactacttagcaccaggaacgttgtaaattatcactagtcaacagcattgatttttagtcgacatttcaatcaggttgaagtagaaatactacccggctcatccaacagcctcttaaccagtccactg

SEQ ID NO: 53 - DNA, 542 bp, Homo sapiens
tgatcaccctggtattgcagagtcagggccccagaccatggaacaaaggggcaggaaaggcaggatgtccctccttgttcctccgtctgccagctccacagagctggaggtggggactggggtcaggaatcagggaccagagaacaaaaggttcccgtcatcccagggcctgtgccttcctctgagtgcagtcgcttggctgaaacaggatgaaaggttttcctggggcccttggagtctgagaagctgggctccagccccactgctgcgatggacatgctgtgtgacctcaagaacataagtccccctctctgagcccctgtctcctcatctatgaaacagggatgataatccttacctcacaggattggaatggtgtcaggatgacatgtgagtttcatggtcggtcagactgacttcagactccagctctgccctctattcgctctatgatcttgtgtaagtctccacctctccacgcctcagtttcctcgtccgaaaaacaaggatgttaagacctcctgtcagctggacacggtggc

SEQ ID NO: 54 - DNA, 652 bp, Homo sapiens
tgggcgggaaggctaacctggtgcggagccagcctgggtctcagccccgcgtacggcctttcacgagtcttcaagccttcaggctttcttctagtcaagatgagtgataaaccagacttgtcggaagtggagaagtttgacaggtcaaaactgaagaaaactaatactgaagaaaaaaatactcttccctcaaaggaaactatccagcaggagaaagagtgtgttcaaacatcataaaatggggatctcctccaaagagcagatttcagcattgcctgacagtcttggttttaggcttgtttttttgtaaacctgtgtgtttgtagagatttcagacatcttctgatttcttctcacctatattccctggttaagaggtcaggggtagtgaatgtttccttaagttcctttttaaacttcccattggtatgtaaattccaaatggcagatgctgtcaataaccttgccatggatgacctttgtgtaggtagtccttgcacctcatgcaggataagccaattttaactttctacaatgggtgcctcaatagtttcataatcttcatgaagttgcatcctttggcagcttcttacagtttattttcacttccaatgtagcaataaaataataaatataatcgttgttgtctgac

SEQ ID NO: 55 - DNA, 441 bp, Homo sapiens
tgggcgggaaggctaacctggtgcggagccagcctgggtctcagccccgcgtacggcctttcacgagtcttcaagccttcaggctttcttctagtcaagatgagtgataaaccagacttgtcggaagtggagaagtttgacaggtcaaaactgaagaaaactaatactgaagaaaaaaatactcttccctcaaaggaaacgagactctgtctcaaaaaaagaaaaagttttctctctttaaacctggaaccatcttactagcaataaatgacctgatcttaaaagtctgacaggaaacagcattggaatttgggatggtaccttcttggtgattgctatttctttaattcttcttaatcgctaaatccttgtttggttcagtttctgggatttatgttttacattcatatatttaataaatgtttctgaatgtattatcat

SEQ ID NO: 56 - DNA, 395 bp, Homo sapiens
atttttgtctaattttaaaaatatatatagcttattaatgaggaacacaaattttgaaaccagactgtactgcctagagaggagtcatgtttcatgacttactagctattgacatctttttctgttgtgattgtttttgattgtttgtttgtttctttttttgagacaggatctcactctgttacccaggctggagtgagtggtgcaatcacggctcactacagcctagacctcccaggctcaagtggtcctctcacctcagcctctcctccagcagctaggactgcagggacgtgccaccaaattttttttgtagagtcaggaggtggaggttgcagtgagctgagatcatgagactgcactccagcctgggtgacagagtgagactccatctc

SEQ ID NO: 57 - DNA, 739 bp, Homo sapiens
gttttgtaaatgctaatatatatatgagtcaatactttctgacatttatttgttagaaaattacacacatttaaaaattcaaattaaaactatgcttctatttaggctattgtaagagatttctttattttcttggaaattctctggaacagtagggtcatttgaatcatacccgttggtattgtcagatacattgtaaagtttcaactattgaacatatgtatggaatagaaattttaaaatagaaaattcgctatcttgccatttaagtatgataaaactatacccgattaaaacgttgactctattagaggttcgcctagtaagtaattctctggtcaagaatttgggaaattttaaactctgttaaccattaaaacaattacttctttaaggtaccggattttcatccatatttgaggagccttattaagttgttgggtggtctttttgtaaaggtttatgtggttaaaaaagtagatcttttcacccttctattacagttaacattaatatctttaaaaggtactatataaatccagacctaatttattctggatgatttttcttaactaaatgaaatctaacaaatttgtctatttttaagtgaatcttttttttatttctagtatttattggaagttcacttagactctatataggttagaagttaaagtaaataattttgactatttttttctttcatttcatgtttgaatatttccccctttacataaac

SEQ ID NO: 58 - DNA, 338 bp, Homo sapiens
actttgaccaggttaggttggttttctatacagatacctgggcaacccttcaatagcctctttcccaaggcagcaacttacatggaagccactgggtgcttaacaatggaagattcaatctttgttgaatagagagggtgattgtagcacttgagctgtgtctcttttcattacacattggggaagtggggaaatgaggaagcttttggaagctaatccatttagtgtgtgtgttgagggtacagggagagattaaaaacaacccaagataagactctgtcgctcaccctcccagagtgatgtggccccaagctggcaagaaaacaattctaatggag

SEQ ID NO: 59 - DNA, 438 bp, Homo sapiens
caaccacttcatactcattagaatgatcattatttttttagaaagaaagaaacaccaggaaataacagtgtagaaactggagcccttgagcattgctggtgagaatgtaaactgctacagccactgtggaaaacgtgatggttcctcaaaaaattgaagagttactataggacccaacaattccacttctgattgtatacccaaaagaggtgacaccagcagtttcttggggatttttttggtagagatagggtctcgctatgttgcccaggctggtctcaaactcctggcctcaagtaatcttcctgcctgggcctcccaaaatgctgggattacaggcatgagccaccatgcccagcctacacaaaggaactgaaagcaagtagaacagaaacttgtaaaacacatgttcacagtagcattattcgcaatagtcta

SEQ ID NO: 60 - DNA, 396 bp, Homo sapiens
gggaaatacacatctcctttggctgcaatagtgagattttggctgctgcctccctgtggtttgggttccactcaattggagaaatattttcatgctaggtagcctaacaaaagacaacagtataactgcaaagtgtgcaaagtacagatgcacaggttgttcactgcagaactgttttttcagtgaatcacttactcttagttcatagcatagaaagcatcaaggaaagaatggaaacatatttttcattttctcaattacacagtatgtttcttagtgaaaaaatacaaaaattcattgaaaaaaatcttcaaccaatatgtcccacacagcactctaagagataaggagtaggaagttttagctttaacttacaggtctggagacagaggcctg

SEQ ID NO: 61 - DNA, 369 bp, Homo sapiens
catctctgtcccactccatgctgggtgtcttgcctggggctgccctttggaagcggccacactggataagaaaatcaaactccccaccaatggacaagcagaaaatatgccagatggggtgcagtggctcacgcctgtaatcccagcactttgggagtccgaggcgggtggatcacttgaggccaggagttcgagaccagccttggtgaaaccccctgtctactaaaagtacaaaattcagcctggtgcggtggtgtgcgcctgtaatcccaacacgagaattgcttgaacccaggaggcggaggttgcaatgagccgagatcgcatcactgcactccagcctgggcgacagagcaagactctgtctca

SEQ ID NO: 62 - DNA, 286 bp, Homo sapiens
ctccctctccaaacgacttccatcattttagttaggttctaggatgcatgagcctctacctctcttctgcatcatcctcaggattaaattcaggaaggagtcagtcagcagccttgattaattctccttcttggctaatctactcttcatgcatagactagcatgcatgcacgcacacatgcacatgcgcacgtacacacacacacacacacacacacaccaaataaagcgtaatatttgcaacttcatgtaagcatatttgcaggacaaattctcttgaaatgct

SEQ ID NO: 63 - DNA, 690 bp, Homo sapiens
agaagctaggaatgaatccatgaccttggatgggcatcctctgtcttccccaggacaggggttcagtgtcattttccaggaacctaatgaagcagccttgttcttctggggtgatacccgagatttgttgcctaatggtcataaaaaactaggatgtggacacacaagagtgaggttaagagcagaagtttaataggtggaagaaagagaaaagctccctgtgctgcagagagaggggtcccaaatgggctgcaggatccacagtgaaatgcatgggattttatagatgcctgatgaggggggcggtgtttgatttacacagggcacgaaagattggttggaccaggtatgtcatttgcatggagcatgaaaaattggttagaggtatgtcatttgcatggattacggaaaatttgcataggtggcaaatttgtgtccactcccaccctaatcttgtattatgtaagtgggtcttaagtgggtcttcttcctgagctgcatcatattgcccattcctttactctacatgtagtaacaacaacaacaacaaaaatggagcctctgtgttggacatgcctggcccacaggtagcccttttctattggcacagctgccggcattcacccttccaagttccagcttgcttatctatgtttgcagctccatttttcaggctgatctttgttagta

SEQ ID NO: 64 - DNA, 848 bp, Homo sapiens
ggccattccagctgaatctcaaacagaaggcagtaatgagagcctacaaatgggagggacctaagtgcctacctactcgctaatcgcaggtgcaaacacacaaggagtttggtgggcttaaggtcagaggagtgtgtagggagggatgtatgtggaaggtaagattcagggcaagctaaaaatccgatactgcaacgttttccaaaatcccagaaggcaaactgtgcatgttctaccctgaaccacccaagcaacactttctaccttgccttatttttaattggattcactgtccaaaatgcagaggtttgctttgcttttttttcagaagttccaaacagcaactttgagagcagtggggtgcttggcagctgttctgtgttttccaggaatccaactgagcattgaaatctctcatttgccgacttatttttataggaagccaatttaaaaaaaaaaaaagttttcttatagtattggaactacttctaattttaaaatgacttttttgatgtattttttgttaaatactatgtagtgtaatgtataattgctcttgtttattgcttttacaatcatatttattaaacagataatgtctctaaagtctttgcctcaggtatttttttttttaatcctaaacccttggtgttcattctaaatatagaagtgttgcatgtataggatttcataaaggctaattgcataagaaagagtaaacaccacaggcttgaggtttttggctgttttttactaacaaggcagaatgtatgtactacctgaattctacctgcatttcaattaactatacaatgtctgtttattaaattactttgatttaaaaatta

SEQ ID NO: 65 - DNA, 437 bp, Homo sapiens
agatggcactgcaagagcagggaggatcacactcatgtccagaaagtgaaacataaaacagctaaacatgtaccacacagctttcatacaaaaattttatatacacaaattttgaaaaaatagagatggggttttgcttgttgtcccggctggtttcgaactcctgaactcaagtgatctgcctgcctcagcttcccaaagtgatgcaattacaggcatgtgccaccatgcctggtgactttttttctgttttgagacggggtctcactctgtctcccaggctggagttcagtggcatgatcatagctcactgcagtctcgacctcctaggctcaagtgatcctcccacctcagcctcctgagtagtgggaccacaggtgtgcaccaccgtgtccagctaatttttgtagagatggggtctcatcatgctgcccagg

SEQ ID NO: 66 - DNA, 532 bp, Homo sapiens
caggttaaagatatcagagacatgatcaagatgagagtcaaggtcaggatcagcaacctctgccctacttcctagcaccaggtgctggctgttgtgaatgcaactttctgaaatgctcttcctccatttatctgcatgtcttcctccttcacgtgcttggaccatttaatgctgcctcacgctccctgccctttcactaggatgtgagtgtcacaaagacagtgatcttggaatgaaatgttttgctcactaatgggtcccaggcagttagaagagtgcttgggccggaggaggcactcgataagagtttagtatcgatgagtgtgcataaaagtattccttgaaaaaagtacatctgggaataaaatataaaagctgttcacagtagttctctctggagtggaattataagaaagcttcatggtcaatttgatatatgttcatattgtttttttttttttgagatggagtcttgctctgtcacccaggctggagtgcagtggcgcgatctcagctcactgcaagctccgcc

SEQ ID NO: 67 - DNA, 823 bp, Homo sapiens
aaaagaagctaacctaaacaggctacattgaaaacctgttgttcagtgtagccacctttatcagtgatctcagctagatcttctggagaacttgctgcagcttctccatcagcacttgctgtttcacctcgcacttttattttatggatatggcttctttccttcaacctcatgaatcacccttgctagcttcagacttttgttctgcagcttactcacctctctcagccttcatagacttgaagagagttagggccttgccgtggattaggctttggtttaagggaatgttgtgaccggcttgattttctatccagaccactgaaactttctccatttcagcaatgaggatgcttcactttctgataatttgtatgttcactggagtagcgcttttttgttgttgttgttcttttgaaacagggtctcactctttcacccaggctggaatgcagtggcatattcacagctcactgcagcctcaaacccctgcactgaagtgatccactgcctcagcctctggagtagctgcgacctacaagcacatgccaccatgtccagctaatttatttgttatttttcatatagatggggtctcaaactcgagggctcaagtgatcctcccaccttggcctcccaaagtgctgacattacaggcgtgagccgccccacccagcccagagtagcacttttaatttccttctagatcttttcctttacattcacaacttggctagctttggcacaaaaagcctagctttcagcctgtctcagctttcaacatgccttcctcactaagcttaattgtttctagcttttgatt

SEQ ID NO: 68 - DNA, 370 bp, Homo sapiens
tgttgctagaaccagataaactccaacaccacttctatatctatcatcctgcccttctgtttgtaccattgattagttctctgtccacttctaactttgattattgccctaaaattctaagatttttggaatgttttccagattttttctcatttcttcatgaaaattgaaagaaatatctttttcctttttataccttattttaggggttatctgagagtaatattatctcatttgtcatgaacagaacttgttgaaaacaatgtcaaatatttaacatgaaagtttaggaaattataattcaacgtgcattcctgttacaagaaacataaaatgtacagaaactgtggtttttccccctgagaaaatg

SEQ ID NO: 69 - DNA, 255 bp, Homo sapiens
ttctttccttttccttcctctctcaacatgtatctcatcaattccaacctgcttaaaacccttcagtgacttcccactgacctaagattaagtcattgctctcaaatatggcactgcttacccattgttctgcatattatattctctctccatcactttctatgttccaaccacattggacttctttaatatcctcaaaactacaagtcgtataccagggaagggcttttacacaggctgtttattcactgtgga

SEQ ID NO: 70 - DNA, 551 bp, Homo sapiens
gccatatgtcagatttctatatgtgctcccttataatcttatgggaccactgtcatataagtgtggtctattgttgactgaaaaacgttgttgtgcagtgcaagactgtactaaggaaacaccatcctcccggtatagaaggtccataccccagattttatgcaagtcactgcctcctagggtctgtttccccatcttccgaataaggagtttggacttgactgattgacaatcagtggcagatacttcattatcttggtcaattagagcccttaatacatttctgctctcaggcaatgagaggaaattagtctagacaagacagataaaagggaaaaggatggttggacttgatcagaattcctaagggaggttgtaacattgttttcctgaggatcttggtgatcagagcagaccctgctggtctgtgatggagcaatgaggagggtgaaccccaagctgagacttaaccccttcccatctgcccaccttcctttccccttcccaagaggctatggtgagcaaatggctttgattcagaggggcctgat

SEQ ID NO: 71 - DNA, 487 bp, Homo sapiens
cccttggatgccagtgggcaaagattctgcaactacggaggggctccttccctgacagagagcaagagagggagaccctgatgacttcttcgtcccacgtcagcaggaagtagttacagaagacccacgacgtccttatgcccaaagcttttcagggtctccaactcttgagggggaatactgttagggtaggcaggtagccagacaagagcaggcaaggaagcccctgggaaaggaatctttagaaatgcagcccgctgatggcctccttggaaacgctgcacgctgagtcagcaaaaggaggagcgtggctacactggctacacctggccttgtggctgcattcctctgttccagaagggaacttatcaaggcccagccagaggttaccaaggtaggagctattccccactaagaagcatgtatacttctctaataattcaccctaatataccattttgttcattaaaataataaaaaaaaccac

SEQ ID NO: 72 - DNA, 292 bp, Homo sapiens
catggaaaagttatcaatgaaatttgctaaatgaaaaaagcctaactcaaaaagttacgtattatattattccatatatatgacattctggaaatgcaaaattatagggacagaaatcaaagggtttccactgactgaggagggaaatgtggctgacttcaaaaaagcagcacattaaaatttgagggaaaagtgtaatgatgcatttttatacatgacacagagttaattttggtgtgtgtgtgtgtgtgtgtgtcctggagtttctaacaacctagttttttgttaaaaa

SEQ ID NO: 73 - DNA, 356 bp, Homo sapiens
tgaaaacagaaaaaaaatgttgttagattgatcattgatcacattagctttatcttactcctactccttcattctataaatatacttttcctaaaccctaagaatcactttttaacaaatctattgttttcattactgaggcattgaattagagtatgactttgggctttgattgaatactgactctcaaaaacctgtgtaataacactaaattggagacacagagagggtcagtgattctctgtgttacctgttttatataacaactatgtttgagcattgtgattttctttgtaaaacatatctccaggctaactaaatggattttaaaaactgatactatcaggaaaaaaaaa

SEQ ID NO: 74 - DNA, 324 bp, Homo sapiens
gcgttgcagacccctctgccccagcctcaggcccaggcttgagtttcctggctgggctgagcctcactacccggcacccaccctacctgaagctggtgatctccttcctgttcatctctgctgctgttcaggtggagcagagctacctggtcctgttctgtacacatgcctcccagctacacgaccacgtccagggcctgaggtctcagccgtgctgagcaccccgctgtgggagtgggttctccagcgctttgggaagaagacgtcagcctttgggatctttgcgatggtgccctttgcgatcttgctggctgctgtgcccac

SEQ ID NO: 75 - DNA, 404 bp, Homo sapiens
cagagtggtaagagagaactaggagtaagtggtaaaatgtccctgatgccatgaagctccattccagatctgtaccaacttttacatgaataagaaatacattttaggctgggcgtggtggctcacgcctgtaatcccagcactttgagaggccgaggcaggcggatcacgaggtcaggggatcgagaccatcctggctaacacggtgaaaccccattctctactaaaaaaaaaaatacaaaaattagccaggcgtggtggtgggtgcctgtagtcccagctactcgggaggctgaggcaggagagttgcttgaacccaggtggcagaggttgcagtgagccgagatcgcgccactgcactccagcccgggcaaccgacagagtcaagtccgtctcaaaaaaaa

SEQ ID NO: 76 - DNA, 580 bp, Homo sapiens
ttccagacgtgaaaatacatatcaaaaacactgtgcaggcaccagagtcctgagattgtcagagaatttctcacagcaatgaaaagccacaagttgaccaagacccatttggtgttacatcaggcacacaggtggtacaatccacgaactaaatgcacttctcccaccctctttctccaagtgaactctgaagacaaaacatcttccgtgtgtgtgtgcaaatcttccatgtgtatcttctgtactggtgtataacattttttaaaaactgtagtaaaatacacataacatagccgggcaccgtggctcatgcctgtaatcccatttctttgggagcccgaggcaggcgggtcacctgaggttgggaattcgagaccagcctgactaacatggagaaaccctgtctctactagaaatacaaaattagctgggtgtggtggcacatacctgtaatcccagctactcgggaagctgagggaggagaatcgcttgaacctgaaaggcagaggctgcggtgagctgagattgcgccattgcactccagcctgggcaacaagagtgaaactctgtctcaaaaaat

SEQ ID NO: 77 - DNA, 361 bp, Homo sapiens
aattgaaattcctgagactgcaagggaccctacactgacagctgacttattgaactttctccagcttcaacagaccagagagtcaatctgtccagttcacttcctgcagtgtactatctgtcaggaagctcaaatccaggcttgtgaaactgagagccgcatccatttcccgtcttttccatgtgtcaggaaataagatgaaattaacttgcacagtaattaacaagtgaggcttgaattacctcaggctgggaagtgccagcctgatgctgagaatcgcttgacccaggaggcagaggttgcagtgagccaagatcacaccattgcactccagcctgggtgacagaaggaaactgtctca

SEQ ID NO: 78 - DNA, 332 bp, Homo sapiens
tttttgttgttgttgttgttgttgttgttgttggatacagagtcttgctctgttgcccaggctgaagtctactggattaatcatagctcaccgcagcctccaactccagggctcagatgatcctcccacttcagcctcccaaatagctgggactacagatgcatatcaccacacctaattttgggggtgggtagggagcgaggtctcactgtgttgctcaggctggtctgaaactcctgagctcaagccattctcctgtctagacctcccagagtgctgggattacaggtgtgagctaccacttgtggcaaaagcattaattctaaggaaac

SEQ ID NO: 79 - DNA, 426 bp, Homo sapiens
taatagtattctgccttctataaatttctaatatattcctcttggcagaaaccatgccattcagttttaaactccctgtacctagcactgaacaggctttcaataaatatctgctcaataaatatatggtttggatgcattgataggtgtaagagcaaatgcgtaaatgaatttaggaattttcaaaaaagaaaataatatggttgttgtaagcctattatgtttggaggcagaaattccacttgagaaacaatccttgtaagctaatgttacagaaattaagtgttaacaatgagaattgtaaaagagggatcatcaaggcagagataacttatgaggctcacattttcttagaataaagataagtaacttttaacctataagcttagctccattccatccttccagccaccaaaacccaaacac

SEQ ID NO: 80 - DNA, 334 bp, Homo sapiens
actttctatgtaagttggtttttaaacacataaagcccgaataccttgttttgtgattagagcccatttttctgctacctctgagtccttttaaggacaagaaccgtgtctaaccgtccaccccttcctcctttccaggtcctgtagaacatagctgcgcctggaattgaatgatcgtgttttccgtgcagagctatctgcctttggacaggaggagaactctcagcaccattccctttccacgggagcttcttttttctcattctttttcttgcctccctcaactcccatcctctgttctgggagaaggtgaagctggcctgacaggcctgag

SEQ ID NO: 81 - DNA, 245 bp, Homo sapiens
gtcatataattagatgaggaaattacataagaaacatgtagagtgaacattttaaatacatgcccatattaattgcagaacacaccctgatttcaaaaacattaaaatatcatttaaaaacaaagagggacatttaagcctaaaaattgacctggtaaagtggtttttagtaacagcaactttttgaggcttagcatgttttaatactaatgggatttttcatctgcttcttggagaaacctttt

SEQ ID NO: 82 - DNA, 387 bp, Homo sapiens
cctctgcctcccggattcaaatgatgatcgtgcctcagccttctgagtagctgggattacaggcatacaccaccatgccaagctaattttgtatttttagtagagacaggggtttctccatgttgaccaggatagtctggaactcctgacctcaagtgatctgccagcctcggcctcccaaagtgctgggattataggagcaagccgccatgcctggcccacaataaaagaaaatcttctattaaaaaaaggaatgttgacatcttgtggtggtagggggccagcttggtataaaatcctggaaggcaagctgctgctggctgggaaggggcctcgccttcccctgaattgcagttgctaatcacacctgctatgggtatttaaatg

SEQ ID NO: 83 - DNA, 367 bp, Homo sapiens
cctgatgttgaagaaaagaaaaatttgcttatgaaaaatatcactagagaaactgttcaaggactgtacctcactgggaaggatcaagccaatctcagggacacgggcctgcttcaaaattgccatcaagttgcaaagcagctccacccctaaatcccaagcaacacatcaggtgcttttactcaatgaagtggtctctgagagaaaagaaaatacaacttgtttgttatgtctttttagagtcaaattgaatataaaacattattcaaatccatatcttcaccatattgcctccacttccagtgggttctcttaagtttggttgttttttgttgtttgtttttttgatcattaaaaatgctgcaat

SEQ ID NO: 84 - DNA, 414 bp, Homo sapiens
atagggtccaggactgcacttccagtttccaaagggaaaagcttacctttcttctaaatcttctattacctttctcattttctcattttctctttttctcttcatgactaggaaaatatcagaccaagggagctgccttggggtgtaatgacataagcacgaacctgacaactttataacttgttccaacaaactgtgatacaagtccaatcacctatgaactctccactaagcattattccctcaaaccaattctaaaatacacaagccattgttaaagctgaggtcaaagcttttaatggaaaagagtatctggcaattttcccatgatgaacgattcaaacattttctttttttttctttttctttttcttttttttttttgagatgaagtctcactctatcgcccaggct

SEQ ID NO: 85 - DNA, 397 bp, Homo sapiens
tgttttccagcagttttgctgggtgactgcaggaagcacttggctttcatcattggccaactggggatatccacccctggaagtcatttgatcacttaagctcccaactcactcaaaaggtagcctgcaagggtcttgcagctttgatccaaattttccatccaaacagccatgtaaacggagaggctcctgattccagccaaggcccaagttgccgctctctttctcaacgaaaagaaagaaaatgtgtcttccactgtggctgagctacctgaacagatcaagtgctggaatgcactgattgctttgaggagcaggatcctttttggcttcatcttttcattttgctgccgggcttaaggaggctcaaattttattgcttgttataagcctcacc

SEQ ID NO: 86 - DNA, 432 bp, Homo sapiens
gctcccagtgcaactgaaaagttaatctaaaaatcttatatcacatttgaaatagaacatgtcccaatattgtttctcatatttgatagtggatgtttttgtgtatcttaaagtgtgttcatgtgttttaagttatggttttatctctagagaaaaagcaatgatgacttctaaatcataaaattgagactcttagatggatggaaaaataatatattacctatatattattcatagataagtagcatttttatttcatttcaaaataattggcatcaatttgaataacgcatagtttaagaagcttgtagcataattaaaaatggcaggttttgctttgttcctgtatcactaatgaactgttagaattttgtagagagctaacaacttttggaaataggaaggcagaaaacattactgatatagtgatat

SEQ ID NO: 87 - DNA, 326 bp, Homo sapiens
cctacagtgtgtgaggaagtgcactggcctcatgcgcagttctctgtgtgagatctgtagggagagaggagcagacagacagcatcccagccctgtggttctcccagcagggccttgctctgctagacccatctttatctgcgtgagcccctcccggaagcccagctctggtcttctgtggggccgtgggtcccagggctgcctcctacccaggaatacagctagaacatgtctttttggactgactttcaggagacacagggtggaacagcctagcctttaaataaacacctcttacacacatgtaaacacacacactggctcac

SEQ ID NO: 88 - DNA, 257 bp, Homo sapiens
tttttagaaaatctctttattagaaatcctctattcataaagtttctgtgtgactacagtactaagtagtatattcccacatttctgaggcagaataaactagaattaagggaagaagtgtaatgttatttttctatgaaatatagtattttggttaaaaccattgggaaacctacttcgattctagttgctgatgaaaattgatggtatccttttattaagcccaaatcttatccacatttaaaagcgtgaaaaga

SEQ ID NO: 89 - DNA, 764 bp, Homo sapiens
aggcttccgaaatctctgcaatgtgcttcaccccattattcccccaacccctgtcagcctaataaaatcatccagtagtttccctataaggtctgagcagagaaagaaagccagttatactattgctacaagtccaggacactgtgccctctccatggctgctgccctggtcctttattcttgctagctaacctagttcacttgtacagtaacacactacctttgctggaaagttagcatgggtctccaggctcagtaatggccaactctactgatgcagaagtatttagggatgttttttccattcattgcactaaagactaaaccaggtcaaatttatctaggaaaaaaaaggtgtgtaagatttgttttgtttttgtctgttaaaaataagctactaaataaaatggatgactctttggtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacttgggggggggccccggacccaaattccccttatggggggccttttaaaaattaagggcccgctttttaaaaactcggtaatgggaaaaccctggggttacccaaattaaacccctttgaaaaaaatccccttttgccaagttggctaaaatccaaaaagccccaacccaagggcctttcaaaaaatttgccaaccttaatgggaa

SEQ ID NO: 90 - DNA, 464 bp, Homo sapiens
gagaggatggaggaagagtgttgaatatggttccaggtggaggaattcattcattcgtttattcagaagctgttctcctagggcacattctgtgcccagactgtgattagaagtgaggtgaggcatctcagatgggtgctgtggttcatgcctgtaattccagcacttcaggaggccgaggtgtgtggattgcttgagtccaggagttcgagaccagcctgggcaacacagcaaaaccctgtctctacaaaaaatacaaagattagcggggcatggtggggcgtgcttgtcatcccagctattcgggagactgagctcgggaggacggcttgggcccaggaggtggaggttgtagtgagccctgaccacaccactacattccgtcctggtggtgaaggttgcagtgagctatgattgtgccactgcacttcaccctgggtgacagagtgagaccctgtttcaaa

SEQ ID NO: 91 - DNA, 309 bp, Homo sapiens
gtaaaatgataggagttaatgttgcaaagagtagtttacatattcaatttctgaagacacttgaatttaggaccgatgtatctgtgacaagcatgctagaagtggcaggggccatcagggctagctacttcatacccactatcctcccctggggatccaagacctgagacacaaagcaacagcctgccgagatctctcttttcatcatatctctttcaaggtttgtccatgccaacacaacctttgggcatcaaacatcagaaggtctgtgtgtctcagccctgttaaggggcaggtttctctttcacc

SEQ ID NO: 92 - DNA, 420 bp, Homo sapiens
agggcacactggaacaagtctagatggtaccttaggtcaactgtggtaagtaatgaggctgggaataactctaggggaaggcaaggcctcttcttgccatgaatctgtggctttctgagataatgagaaggcatatgcaccctcttctgtcctcaggctcctgttcaaaatatttctcttagttttcctcataaaattgtttgatctaatagtgtgtagctgttaaagcaaggctacatgttggtattaaaaaaattcatctggctgggcgtagtggctcatgcctgtaaccccagctctttgggagccaacatagtgaaaccccatctctactaaaaatacaaaaattagccgggtatggtggcaggcacctgtagtctcagctacttgggagactgaggtgggataatctcttgaacc

SEQ ID NO: 93 - DNA, 411 bp, Homo sapiens
gcttctcagaaaatggggcaaaaaatctccagacagccctactcaggttcctggtctctgttctcatgttctgacccccagaaggcctctaaatcactcaacttggagactcgccagttttttctaatcagctgcctgaaagcggttcagagttctgtcaacaagcccttgcacgctgggcttattaatgctgggccactcagagccatgactcaggaacatggcttggggtcaacactgaaaagcagaaatcacagtactgataatgggaattttgtaggaggaaacaggcttttggaacttaatgcctttgttaggtttctggatttgcagatctcattgtgtgggcctgctttaggaggaaaagctgggattcataacaatctaataaacctgacccaaaccacctgc

SEQ ID NO: 94 - DNA, 469 bp, Homo sapiens
ggcatgggtaacaaacatccactgctgggaacatgatgtactctgtctaatcctccccagtcctgcaaaggtgggcatgaagagccacgtttcagagacgaggaaacggggagaggctgaataactctccaaagcttatcctgatagtgagttgtgaagctgggatgggagccaggcctgtgaagcctcccgcaaggcagcggctgactcggaaaaggtgtgaacccagcctcagccaacacaggaaaggaaaggagcgacaatggtaattgaggaaattagagtctaggttccattctgaaggtgtcatgttgcctgcactggtaattgggcaatttaggactaggagggtccatctgttctcaacactctgcttcctcaaggctttcagtccctggctcgcatcaactccaaggatggtgtaggtgaggggagtatgcaagtgcctctagagctggaagaggctcag

SEQ ID NO: 95 - DNA, 457 bp, Homo sapiens
ctcagcctcccaagtagctgggattacaggcacgcaccaccatgcccggctaatttttgtgtttttagtagagatgggtttccaccatgttggccaggctggtcttgaactcctgacctcgtgatccacccaccttggcctcccaaagtgctaggattacaggcgtgagccaccatgtctggcctcatcatttttaatgaattgagagcatgaagtaaagtaaaacaatagggggttacaaagtctattgctgcccctttgcaatgaataaattgaagctgtagaagttgtggtttctcaaggtcacagccaggactagagccaggtctcttttcctcatccagcccaatgcccttcctacaacaccttgactgctaatagagaaggacattattaatacatggttccagtagtcaggtctctttttgcacaaaggttacctttgcaggttttatgc

SEQ ID NO: 96 - DNA, 318 bp, Homo sapiens
ttggcagggggagaggaaagagtgtccccctttatgatgctgaactaacttgtagaatctgtgatatgtttaaacccaatgccttctgtgagaggcccagcaatgtgatagaaagaggcagtgtgggcttcaagacaattgggcttaaatttggactgtagggtaggtttcttcccttatctaggcctcagtgttaccatataaaatagaggggttgaattcaatgccttgtgagtctgtgatgctgggagcccatcaaagtcgacggttgtggtgacagttttccagacttcattcaagaggtcgctgtcagtctat

SEQ ID NO: 97 - DNA, 772 bp, Homo sapiens
ggctaatttttgtatttttagtagaggcggggtttcaccatgttggccaggctggtctcaaactcctgacctcaggtgatccgcccacctcggcctccccaaagtgctgggattacaggcgtgagccaccgcacccagcttttttttttgggggggggcggggagagatgaggtctcgccatgttgcccaggctgaaagtaaaaattttatgacctcaagagttgaaaatgatttcttctttttatttttttgagacggagtctcactctgtcgcccgggctagagtgcagtggtgcgatcttggctcactgcaagctccgcctcctgggttcacgccattctcctgcctcagcctcctgagtagctgggactacaggtgcccgccaccacacccagctaatttttgtattttagtagagacggggtttcaccgtgttagccaggatggtctgaccttgtgatccgtccacctcggcctcccaaagtgctgggattacaggcgtgagccactgcgcctggccgaaaatgatttcttaaataataacacaaaaagtatacagacccctaaaaccctgccaataacaagtattggttaggcagcacagaacaggacctgtgaatttgatgagttatcactcctgtgatttgatgatgtcatatggcatagttgcccttgttttgttttgctttgttttgttgagacagggtctcatttgttgcccaggctgcagtgcagtggtgaaaccataggtcactgcaacccggaactcc

SEQ ID NO: 98 - DNA, 1164 bp, Homo sapiens
attgtagctctgtatagcacttggataatgtctgggtgtctccttaaccatcaaactgttctttatttgctattgttgttcctaaagctaagctttgctgggaaggaaatgacctatagtttcttaaagaatcattaatccttataggattcctgagttactgttttgttcctccccactgcttcccattcctgagttttgtaattcctaatccttctataatttctattaccttcaccatagtcattctttccttacgcaaagcccaaggaatgagctgctgctactttaaagtgtggtcattatgatgaatgtgaaaagagttttggcttgttctaaataatttttacaagttatggtacagacagttgttacatatcaaaaaaaacctgtttattgaaacaggaaataaaaaagggatcttttacattatagaattaaaactaattttttcttgtatataaactaattggtttgattttaaatatttctggcttttattaatatgtcttaattttgagtttgaaaatgttaagtgcaataaaaacatactagtacagattttgttttgttccaattggcatactctggggatgatcacttaaaaaaacagattttacataatgcctacttctggtagatgtcttatgagattgttctgctttttctaagttacttagatgttggatatgtacatagctgtttcttgttctgtatacatttctcaaatgtacacttgtattataataacctcccagttctaggggatatttgtgcaataaatacacatgtcaacttgaaaaaaaaaaaagaaaaaaaaaaaaaaaaaaaaaaaaaagaatgataaaaagaaagaaaaagggggggggaaaagtcgggggaagcgcaccaatcaatcagcggcaccacctggtgcagtgaagaacaggggctgccccaaactgggacagccataatcaacaaggccaacagcacgcgcgcacataaacaaccgcgcggcggagaaaaacacggtcgcaggcggaacataacgaggaagaacccccccattggggagggaccaacactggcggacacagccccaagaaatcgcgcgcagcgacaaacaacgggtgctagaggaaccacgcagacaacggcgcgaaacgcaccccgtacgaaaaa

SEQ ID NO: 99 - DNA, 375 bp, Homo sapiens
tctcagctcactgcaacctccgcctcccagttcaagtgattctcctgcctcagcccccaagtagctgggattacaagtgtgcgccaccacacccagctaattttttatttttagtagagatgagatttcaccatgtgttggtcaggctggtcttgaactcctgaactcaagtgatccacctgcctcgacctcccaaagtactgggattacaggcgtgagccactgtgcccagccttgtacttttttttttttttattgtagctctgtatagcacttggataatgtctgggtgtctccttaaccatcaaactgttctttatttaaaatgtttaattaccgtttagaaattctagtcctcaataagtgggtggctca

SEQ ID NO: 100 - DNA, 418 bp, Homo sapiens
aacacactggggggttaggcttcaaccaattaatctgtagaggacaaacacgttcagtccatagcaggaagcagtgccgccatggggaagagcattgtcgtgaaaccttttgcccctcttgttgagttttctcctccagcacaccctgaacatgctgacagtgtcaccttcctctttacttgtccctcttccgctccaagttgcctcctggcttcccagtgtctctgtgggcttgagaccagagcttgtcataagagatagatgacgtcacttgatggaaagagtcaagtgcagtgaccagcacatagaaggcggccatcaacattggtttcatcctttagagcaaagtttccccaagcgcctggtgtgcactggtgagatttggggacggggtggtacttaagacctggcactaatt

SEQ ID NO: 101 - DNA, 491 bp, Homo sapiens
gacttctcccaaaatgcagaagggggtttatagacactatttcctggattttgacggggcaagatgacatttgggttgcatcggtggagtttcccaggcctgtctcttgtattcatcattggtacctcttttctttttcgggaaactgtggtagagggaagaggagttttggagacaggctaacctgaatttgcaaccaatctctgtttctgttgcttaacctatttgagccacttagtttttcagccataaaaaaaagtctcacaggacacaggattgtgaagaggcttaaattaaaagacatctcatacacaggttaaaaattcaggtcttaacgccaaagtgcttgattcaaatcctggctctaccatctgctagccatgtgaatttggataagttattcaatttcctcttataaaaaatggggcagctgggcgtggtggttcacgcctgtaatcctagcactttgggaggccaaggtgggccaatta

SEQ ID NO: 102 - DNA, 358 bp, Homo sapiens
tttttctttccttttttttttttttctgagatagggtctcaccctgtcacccaggctggagggcagtggcatgatcttggctcactgcaacctccgccttctgggttcaagtgattctcttgcctcagcctcccaagtagctgggaccacaggcacgagccaccatgcctggctaatttctgtattttttggtgagatgaggtctcatgttgcccaggctggtctcaaactcctgtgctcatgtgctcctcctgccttggcctcccaaagtgctggtattacaggcatgagcaccacgtccagccccatttcactttctcttagtttccatgtctctgccaaaattccctatctgttc

SEQ ID NO: 103 - DNA, 332 bp, Homo sapiens
caaactgagaggaaggtacagagatacctcatatacccccttccctacacatgcataacttgacctcattatttccctttttaataaatggcaactttgtcttccatttgctcagaccaaaaccctggagtcatccttgatgtctcaagaaaaagatcttatacatttcacattcagtctaattctggtcagctccaccttgaaaatacatttagaatgtgagcactttcatcattaccaaagctatactctagtcaactgcagtagtttcttactaatttcccagtgtctacccctgccctctacagtatgtcttccacaggcaaccaaaa

SEQ ID NO: 104 - DNA, 351 bp, Homo sapiens
tttttttttttgagacagggtttcgctctgtcgcccaggctggagtgcagtggcactatctcggctcactgcaagctcagcctcctgggttcacgccattctcctgcctcagcctcccgagtagctgggactacaggcgcctgccactgcacccggataattttttgtatttttagtagagacagggttttaccgtgttagccaggatggtctcgatctcttgaccttgtgatccacccgcctgggcctcccacagtattgagattacaggcgtgagccaccacacccagccgtctatgatctatttttatgttcatttttgtataaggtataagatatacgtggaggttc

SEQ ID NO: 105 - DNA, 598 bp, Homo sapiens
gggggtaaccctcctatcctgctgtgagaatataacatggtatagccaccttggaaaacagcttgtcagtttcttcaaagttcagtgtagcagggcgcgatggctcacgcctgtaatctcagcactttgagaggcctcccttgatcatgaggtcaagagattgagaccatcctggccaacatggtgaaacctcgtctctactaaaaatacaaaaattagccgggtgtggtggcgcgtgcctgtaatcccagctactcaggaggctgaggcaggtgaatctcttgaatccacgaggcggaggttgcagtgagccaagatcatgccactgcactccaacttggtgacagaacgagactccgtctcaattaaaaaaaaaaaaaaagttcagtgtaaatttaccctattcctagtaattgcactcctacgtaaatatccaagagatatcaaggaatatgtccagacaaaaccttgctcaagtatgttcactgtaacattattcccaatacccaaaggtggaaacaaccaaaatatctataaactgatgactggatcaacagacagtatgttcatgtcacagaatagttagtgctcagcaata

SEQ ID NO: 106 - DNA, 455 bp, Homo sapiens
  misc_feature (1)..(1): n is a, c, g, or t
ncatttagcttggcgttttattcattccatcaccccttactgtaactactatggcaactccaaataattgtcatgggactatgtcccatcttaatgggtctggatggcatggtgctcctcttaagtgtgctggaattctgcattgctgtgtccctctctgcctttggatgtaaagtgctctgttgtaccctggtggggttgtgttaattctgccatcacattctcacatggcagaaacagcatctcccacaccacttaatgaggtttgaggccaccaaaagatcaacagacgaaatgctccagaaatctatgctgactgtgacacaagagcctcacatgagaaattaccagtatccaacttcgatactgatagacttgttgatattattattatatgtaatccaattatgaactgtgtgtgtatagagagataataaattcaaaattatgttctc

SEQ ID NO: 107 - DNA, 338 bp, Homo sapiens
cattattagagctaaatacagagataggctacaatataataagaacaggagactttaacttcctctttcatcattggacaaatcatttggacagaaaatccgcaaggaaacatcaggcttaatctgtgctatagatcaaatggaccagatagatatttatagaacattttatcaaatggctgcagatgcacattcttctcagcacatagattattttcaaggataaatcatattttaggctaaaaaacacgtcttaaaaattaaaattaaaattaaattttatatcaagtatcatctcagacttcagagatgacgcaaaactagaaatcaataacaag

SEQ ID NO: 108 - DNA, 396 bp, Homo sapiens
ctcaaaactgatgcgtatccagagagaggcaatatcctcctcattatcacagacagtgtccttaaaaaaactgccttttaacttttcagcaataggcactgttaaccgtccactctttcttgaaattcactcatctcttgattttatcataatatttacaattggctcttttttggctgagccaattctttatttacatattaattgattcatttatctattctatttaatagataaattaattactcatctattcaaaaatatttgcacacggtaaactgaataaatcatcagcttagtgaattgtcacaatatgaacatgtttatttaaaactatctagatcgtgaaataatctatgaccatcacaacagaagcactccttatacactttccca

SEQ ID NO: 109 - DNA, 474 bp, Homo sapiens
gcccaaggcatgaggcagagcccaagacctgctgagcccatgggagtgagccggggcaactgaggcagggagcctgggaggaagccatcactgaggcaggcaggagatcagcgggtggactggaaagcaaattaggaggaaaacctaaggggcgattgggtcaaatcaaacagaaggactgagtgtgggggctgacagagaaggaggaatcaggagtcctgtccaggtttctgaccagcaactggagagatgcttactgagacagtggccatgcgggaaggcgggaggggtgttcagaacgtgctcaagttcacacatgtggggatggagatgctcttaagctgctgggctgtttctcctgagacaagcccacactggagcggccagcagcctacagatggtaattaaagccacagggaggatgagctcacgcagggagaacgcgtggagggaggaggtgaggactgggatcca

SEQ ID NO: 110 - DNA, 435 bp, Homo sapiens
gtggaaccctgctctactaaaaatacaaaaattagccaaatgtggtggcagctgcttataatcccagctactcaggaggctgaggcaggagaatcgcttgaacccaggaggtggaggttgcagtgagccgagtgcagtttgggtgacaagagcaaaactctgtctcaaaaaaaataagagaaatctttgggatagctgtgaggcaccatgatgttgaggtaattgcatgggttttagattcccacctcgggtttgaatcttggcctggccacttctgagaccttgggaatccacttggccatttgagcctgagttgtctcatcaaacagaagtaacactattaatcttgtgagtgttgattgtaataataaacatgaaatactttgtttacagccttggcatattggaaatgttaataaatagtaacttctgtca

SEQ ID NO: 111 - DNA, 383 bp, Homo sapiens
catgcccagcgtgatgacaagcagcaggggttttgaggggaacaaggcagacatggcccttgctctcctgaagtacatagccttgcttacaatacttgtcattggccgggggcagtggctcacgcctgtaatctcagaactttgggaggctgaggtgagaggatcgcttgagcccagaagttcaagaccagcctgggcaacatggcgaaatctgtctctaaggaaaatgaaaaaaattagccaggaaaggtggtgttcgtctgtagtcccagctactcatgaggctgaggtaggaggatcccttaagcccaggagatgcaggttgcagggactgagaacatgcatggcactccagcctgagtaacagagtgagaccctttctc

SEQ ID NO: 112 - DNA, 150 bp, Homo sapiens
cacttgttaccatacctacccgagtttaaaatataaaagtttaaggcagttaacattagtctgcatctgtgtcttaccaatatatatgtataggcaataaatggtaataaaagttatggggtaggaatagaaatactgggcttaaaagca

SEQ ID NO: 113 - DNA, 299 bp, Homo sapiens
ttccctctaaaccaggttatacaagagtatacatttcattgccacttttctaaagcaactcatctgttttcatagcgaattctactattcaattggattcatgaaagttgataagaatacaatttgtaagattaaccctctaacaaacaacctgtaacagttcctactccctaatcatctcgtcaaatggtaccaataagggaggctgaaggaagagggggagatatatatggtttgatggagaggcagtaatataaaatgcgagaaaaaaaccatttctcacagggtacacctttctc

SEQ ID NO: 114 - DNA, 399 bp, Homo sapiens
ccataagagtagaggtccttggattttactctacccttactgaaatgaaaaatgcatacttaatcttagtctttttatttagtttcattaataatgccagtggtaataggaagagctgtgcagttaaatgagggtttgaatcaaggctacctgagcctcagtttgtttatgaagttgggataatatccagtacattcaagttctaagaattaaatgagataatctatgttaaatgctcagtaagtgcttgttgcaaaaatgatagtattgccatagagcagtaaagcaatctgtgcttttacttgtaaaatttgcttagttctgagcatggcagttcatttcctagtcactcccaggcttatctattgtatacactgttatacactatattatatacta

SEQ ID NO: 115 - DNA, 408 bp, Homo sapiens
gagtcaatcagcatttactgagcacctactatgcggctcctgcacctcttcctgcccgaccaagcccgattcaggacgagggcagggctgagcctgtgtgagcctgtgacctagggtctctgtggcttcacacctgagcctggtcagggcaggcaggtgcagactggggtaaccgcagcccaggtgcccacccagggcctccttagagccaccccttcctctggagcctccccctctcttgcctgtttctcagcagcttgcaaaaccagttaagccttaatctttggtgattgaaggggtgtcctagtcctaaacccagctctgagccagagggagcccctgctgggagcacctgccagagtcacaggccttcctcagaagacaggcaggatggctgggtgtggcagc

SEQ ID NO: 116 - DNA, 407 bp, Homo sapiens
gtttttcaaaaaaaatttggggggtgggaggtcacactcttatcactgttttctatgacatagggaaactgagtcatgttcccagggtctgcatagctagtaagttcttggaatgggaagtggtcccagttctgattcccaaaaacacatggcttaaccatgccctttaactcagctttcctgagtcccaaggaggaaatcccatgctctctcctcagaactcccccaacctttgcatttctgtggacacctgtcatttacttgcatggcaaggaaatatgttgcatagtgcttggcacatagaaggccctgagagtacttgcgcttcttgcccttcctcctgaaggcaagccctgaatcagagtcaggtttctaatgccggcagcctggtgcctggcacgtggttg

SEQ ID NO: 117 - DNA, 474 bp, Homo sapiens
cacactaagccactgcgctggtttagaactgtctgaagtccctcctagaggtcgtgtgtttgattctgcatctccgtgatttgtgaatcttgcatcatttaaattcagccttacacactgatgcctttggtgccgtcccaatatttaggtagcaaactcgtagtgggtagagattcaggcttaagcttccagcctggctctgaggagaactgtctggggctccctgccctcttccccatggatgagactcttcccagccttgggcaaacacagcggggagctggcaccatctcccgctagacacctcctccttttcctcttgcccttaccatgactcccgagttattctcagaagtaaaagctttccacgcctgctcttctctcctgcagccaggagtgcaaatttagatattggagctgctcaggcagaaaaatggccctggaatcagggaagcagaaacctgcagctgccac

SEQ ID NO: 118 - DNA, 414 bp, Homo sapiens
atcacccgggcccagggtacagcttgcaagagccctgaggccagggtcgaggttgaggacagcagggcgggctcgcagccgagtggcccctgggacaggggaggaggccactgtgagccgccattgagacttttattggagtgaaatgggggctcaggcggctgatggaggaggcatgtgacctacataaggttttcaaaagattgtttgctggatgggggctctgatgccaggggagctgggtacgggtcccagcgagaggagaccacctcgatctgagcaggtggtggctgggagggcaggaagcattagagccaggtgtggctggaaggcccaaccacatgggtttgctgactgatccgctgttggggcggaggcacatttatgaaaaggggaaggactcgggttgagccc

SEQ ID NO: 119 - DNA, 370 bp, Homo sapiens
ttctttttttttttgatggagtctcacttttgttgcccgggctggagtgcaatgctgcgatctcagctcactgcaatctccgcctcctgggttcaagaaattctcctgcctcagcctcccgagtagctgggattacaggcatgtaccaccacgcttggctaatttttgtatttttagtagagaaagggttttgccatgctggccaggctggtctcgaactcctgacttcaagtgttccacgcatctcagcctcccaaagtgctgggattacaagcatgagccaccgcacccggccgatccttcttaatgtaggtaactctttgaaaatctgtttgtgaacccataaaatggatcctataaacgtgctcct

SEQ ID NO: 120 - DNA, 716 bp, Homo sapiens
attccaaactattaaactgcaaaagcagacatgagaaaagaaacttaagtcaatgtttttatcacatgttggtgccagcgtcccatagtggtgctaaatttatgaaattgcaacaaaacaaaaacccaaacaacccaacaacgaaaagctatttagtgaacaccgtgactaacaagcttattagaactgcttatcagagctatgtgtggattttgtagggggaaagattttcttccctcgtagacattttgcaaaataaaagtaaaatattacctttatgtacgtggtagatagaattccacaagcttcaaattcaacgactcaaaaaggttgcttttactttcccatatctcagaagtcacttttattttatttattttttagagatagggtctcgctctgttgcccaagctggagttgcagtggcacaatcatagctcactgcagccttgaactcctgggctcaagcagtcctcttatctcagcatcctgagtagctgggactacaggcgcataccaccactcctagctgatttttaaattctgtgtagacataggatcttgctgtactgcccaggctagtcttgaactcttggcctcaagtgatcctcccaccttggcctcctaaagtgccgggattgcaggtgtgagccaccatacctgcccagaaatctcttattttaaaccccaattcctcctgatagtaaaaaaaaaaa

SEQ ID NO: 121 - DNA, 240 bp, Homo sapiens
tggatataaacctaggagtagaattgttttatcaaagtgtatttcttttagctttttggggtaccactgaattatttttaatgtgtatatatacacagatatttgtttttgagacagagtctcaccgtcacccaggccagagtgcagtggcacgatctcggctcaccacagcctctgcctcctgtgttcaagtgattctcctgcctcagcttcccgagtagctgggactacaggcgcatg

SEQ ID NO: 122 - DNA, 378 bp, Homo sapiens
cttcgggctgtaaagaaagcatagttgtttctgcttctaggaggactcaggaagcctcacaaccataccagaaggccaagcggcaatgaagtgtttcatatagcaggagcagaagcacgacagcgagaggaaagaggtgccatatcctgttatgcaacttgatctcatgagagctcactatgaggagatcagcatcacaaagacgatgcttaactattggtgaaggatctgccccccaccccatatccacccctcgctgtctccatgcagaagcctgagacagaggcagagcctcttggaaaacctctactagggcagcgcagaaggaaaatatgggtttggagcccctatgcaggaggccaccatcctccagacccc

SEQ ID NO: 123 - DNA, 441 bp, Homo sapiens
aaccagtgataataccagttgctctcctcatcatgtgtatttggtcgttctcgcattgtataaagaaatactcaagacctagtaattttttaaagcaatttaattggcttatggttctgcaggctgtacaggaagcatggcaccaacaactctcagcttctgcagaagcctcagggagcttttactagtggcagaaggcgaagaaggagcaggcacatcacatggagaaagcaggagcaagagagagagaggggagcaggtgctacacactttcaaacaaccagatctcttgagaactcactcactaccacaagaacagcaccagctgggtgcagcggctcacgcctgtaatccaagcactttgggaggccaaggcaggcggatcatctgaggtcaggagttaaagaccagcctgaccaacatggtgaaaccccatctcta

SEQ ID NO: 124 - DNA, 459 bp, Homo sapiens
atcaaaaaagccctttcctaaactatatccacagtgaagttatatggtcctcccccactccaggcttgttaagaaaaaataacacagctgttcctaaaaggcagctgacaaattcaccctcatcctttttctatactcctctacccccacttgaaacaaattttggagacaaggccattgctactgtgatgagaaaggagctctcctccccagtttctgttgtcaggttagtgcaaatgtcagaaatggccactatcagttgtaaagaactgtggatcactgtggtcaagtgccccggcgttgctgttagtttggtcactgaatggaagaaagaactggcagtttagaggaatacccctgagacagaaatctcattttaatctgcatattgcagactggtaaacttacttggaaaaaaaaagaaggcgctcataatgtccctctatgttgtgctgacga

SEQ ID NO: 125 - DNA, 358 bp, Homo sapiens
ggtttgcggaaattaaaaattaaataacatggttataccagctagattttgcatcatccagaatgggtgaaaaatatgaacatatttttatatgtcaaaatcagaagtcactctagaaatggatatgaatagtctttaactagaatatcagagtttcacaaagctttcatctctgtagctgcgatatagccaaatttgcatttcgaggactgttccagagtatagttttgtaaggcctgaaaatgagaacttgattttcatcatcctgaactggtctttgaacagtgtgccaagggtgatcaacattaaatatatgctctaagtgtctcttgattatagggacattggttaaataatg

SEQ ID NO: 126 - DNA, 447 bp, Homo sapiens
gtacaaagatacttactgtttggagtttgcataaacatacttgtttaaaaacaacagcattttttaggctaaatctgtttttccattagttgaagtcatagaaccttcaaggcttcctgcatttctgtacctggtatgtcccctcacattttggaactattatctccttgtaaattattagaaaaattaaattagattaaaacttcttgagcatttctttattaggaaaaatggaaatccattacatattcttttgcttgcattcaatcttactgtgctttttactgcaagctgaagtcccctttctactttaaatgggagagaaaatcttgtgctgacatgagatgctcattaccaccaaggcactcattaccaacaagggcagtaaaggaatcgcagctttggctgcctctcacactgaatctgagagttgctattattagaatg

SEQ ID NO: 127 - DNA, 360 bp, Homo sapiens
aaaaggaaagttgcacactttgaaggctcagcttctccagtagaaagtaacctgtggggctatagaaaggcaccaggtatggaatcccaagtcagttccttctcagctatatggatttaggaatacattcagcctcaacatgctcagctgtaaaatgggaataaaaaaactgcactacccttcatattcccgaagactgttgcaaaaatgatctttatggattcacatgtaaaaagaactgcacaataataaaaaagtatttcctattacagtgattttgtttaccaggcaaataaaacagatttggacacaaaatggaaaaggtcatatattataactaaagtctccttggtgatataa

SEQ ID NO: 128 - DNA, 251 bp, Homo sapiens
tgcatttcttattgaaattgaacccagactggggactgtgccatttttcccatttgttactactgttctcttacaccaatgtcttttttgactgctaaacttcattctgtaaaggcaaaatagaaatttttttccaaaaggaaaagtctatatgccttctgtacaaacttgtgaaattagactaaatggggaatcatcacgagtccttaagtaaagggcaatagataaaatttccaaaacattaatttttt

SEQ ID NO: 129 - DNA, 396 bp, Homo sapiens
ggagaatgacccaataatccagtgaggtcctgacacttatttgtatacccttcttcacagggacagggttgatgaggagtgtagggataaatgacttacaggggaaatgaataagcccaaagcacggtggtctgggacaaagttcctctgagctctaggacaggtggagggaaggtgagtggttgagcttcactgtaatcaaaggttatcttattatgcagataaagcctcccaggtaatctcttggagctgtcttgagaagaatagatgaaaagtctttctgggtgcagtggagactcccagtgtctcctcttctccagtggttaatctttcctggttgtttgatgagattcctagggaggaggtcttaagacaattgcatttccttttaaaggg

SEQ ID NO: 130 - DNA, 406 bp, Homo sapiens
ctccattgatctacttatgtctgttgtggcattggccctacaatgctttatttacagtggctttaggattcattttgatgccattagtattaaaaatgtaccttgctgtttttgagcaaatacatgtccccagtgaccaagcttagctgtgaatgttgtcgtggacatcagaggcaggcctagccagtggggggcatgggctttgggaatccttatttgttgctgcttttaaaaatgtggctcataaatgcccctggcatttgctgtcagagaggcccttctgagtgtccctgacatagggcacagtctcgcagggtggccaccttaagctgcaaccccagttataggttcgtcaaagatccagttgtgatgttacacacccatgccaggtgcacatcacaatccc

SEQ ID NO: 131 - DNA, 387 bp, Homo sapiens
gcagatgttcatattttggatagggtaaggtcagtgccgtcgtcagaggaaaaactctcggccatcacaggatgggagagaaagtttgagttgtgaagaatactcaaatgccgtttaaggaaatgggttcttctgcacctattctttggaatatttagggctaagttcttagtttttgacatcataaaaatgtcaaagtattctgttctaagagccatttcaaacaactgactagaatttcagagcaattacatgagagtaataccattaaaatgtttaaattacccatagtcctatatccctaacaagtatgttcacgcttgcatgttctcttctcatctttactgtgtgcatactttcttagtaatggcacgtagacattgttta

SEQ ID NO: 132 - DNA, 515 bp, Homo sapiens
agttaacatgcttttcttgtatttgtactcaaataatagtttggtggggtataacattccagaatttcatttttttttccttgaaacattttatgcatttgttgtttcactgttctctttattcatattgctggtagaggtctgacgccagcctgcattttgcacccttttcatgtatttttgttaaactgcactctcacaataaaacattctttgaataatcaatcacgtgtttattatttactggatttttttcagtgtctgacctactctacacacatcaagggattcaatttctttggcattcagtaattgtactataatatggcttgacattgactgctctgttaaacttcccttggacacagtatgccttttcagtcattagattcaagttagcttttattactgggaagttatatataatgttcttgaaataagtaaaataatggagatcagttaaatacatatgggctctccactgcctaccttcgttgtcttttcatatctttaac

SEQ ID NO: 133 - DNA, 378 bp, Homo sapiens
agatgatgtatgaaaaggctattgggaatgccatgtacagttgtatcatctgtgcactgctcaaaagcacctgctataggcaggaggcaaggctagaatccctatgtcaggtcacattccagaggaaggggcaccatttttgataagtccacccagaggggagtgcctttatgtgcttgtccaccatgaggggcaacatttaggttttcttatgaaggctgagtaggaggctgcctggcctggagcagcggccagttcctgcccagaggcagtactgaaatagtccctgtctgtcttgatgagcattataagactgtaattatgagcatgattaagtgtgctgagtcccctgtcatcgctgtgacctcaccccaaaga

SEQ ID NO: 134 - DNA, 242 bp, Homo sapiens
agcaaaatcctgtctcaaaaaaaaaaaaaaaagaaagaaagaaagaaaccgaccaaccaaccaaacaaacaaaaacattagccaggtgtggtggcatgtgtctatagttccaactactggggaagctgagatgggagaatcacctgagcccaggaggttgaagctgcagtgagctgagccatgattacgtcactgcattccagcctgggtaacagagagaaactttatctcaaaaaaaaaaa

SEQ ID NO: 135 - DNA, 544 bp, Homo sapiens
ggcttttgcctcttatacacatgttaaagctgattatgatgttagataacatagaaattgggtgtttggactcacaaatagattttcagaattcagatgtatgataaagtggagtgatggtaacaattttttttttttaacggctttttggttttctcttcctgactcttgtcaaagaatttcttgctcttgagggaaagcccatgggagagtgaaacaaagaaaattagtagaaggcactgaatgccaaaaatgtcttcttacatataattataatcaattatttcccattattgtcaatatccttccctaggatgtatcttgactgggaaaaaaagtaacttggaagagctaaagcagtatagatttgccatgctgattattttaaatgtaaccagaatggcttttgggaatgccaaatttttataaggtgcagtagacagatagaacccaaggataaaaactttcacatggttctttcagatttgatgtgcattcattaataaagttgtcagaacccattgtatcaaaccataacatgaaa

SEQ ID NO: 136 - DNA, 440 bp, Homo sapiens
agcaaccatacagacctgtgtttgaattcctcctctgccacttcctagccatgcagcactaggcaaatcatttaaactctctgaactgttcttcatctgaaaaaatggagattcttctgaatatttattatatgcccactatgtgtcagatgctgttctaggtgctgggggtctacttgtgattaagagtattaagctcggacgggtgcggtggctcatactttttttttttttttgagaaaggcagtattggcacgagttcctgtgtcgaacccacccacccccggggaaaagtggtctcccatgaacccagttctgggtgccaaaagggtgggggatagctgtggtaggaaacttctgggggtgggaacaaattcagtaaattggggtcagggcttggaaaatttggcctaaatgaggggtccgagctcgatttcgaa

SEQ ID NO: 137 - DNA, 317 bp, Homo sapiens
agcaaccatacagacctgtgtttgaattcctcctctgccacttcctagccatgcagcactaggcaaatcatttaaactctctgaactgttcttcatctgaaaaaatggagattcttctgaatatttattatatgcccactatgtgtcagatgctgttctaggtgctgggggtctacttgtgattaagagtattaagctcggacgggtgcggtggctcatgcctgtaatcccagcactttgggaggccgaggcggacagatcacgaggtcaggagttcaagaccagcctggccaacatagtgaaaccgctgtctctgc

SEQ ID NO: 138 - DNA, 316 bp, Homo sapiens
ggccatctctattgctccacttcctcctgcctgtgctccacttctgccactacaagaacagaggcagcatgctgcagcacaaacaactgaagacttcagagtggggcagacctagctgcagtcctatctccaccacttagtgctgtgtaatgctgataagctgcatggcctccctgtaattctatggcatagcttagaaagtggggacttcagtaaaaacatgtgggctactgtgatcaagtgagctacttaggtgaagcacaggcagtcaccccctagtgatgttggctcatctccacagggtgggctgaagtac

SEQ ID NO: 139 - DNA, 598 bp, Homo sapiens
ttgggggctgtattacagattagtgatttctgccctctgaagccagttttatttgttaagtgttttgcatgactttatttttaacgagttttgtggtttggggctgggggcaggcaagtggagtggaaatgtggggtgctcttgatggaaagtgtcttgaactcttctgtcagtatatatatatacatttgagctgatattgtattcccatgaacatcgttttgcatgtttcttgtcacatgtcctacttctaaaagtatttaaaaattagaaaggaatgtacctagtattgtcacatcctttgttaaccatacttacatgttttgtttaacaaagaggaggggaaaaggagaaaagaatggtggtgtaaactagtaagggggatggataggtttttactaatttgcgctaaaacccaaatagattttcttatttctggactctaagaatggtccttgttgctcttgggaaagaggttcacagcttttctgtcctgggggaggaagaaacactcatcttctagaccccagcagccagagcatatcttccacggaaaaaaacagccagcatccttctctcaagtgtgcctcttccatgg

SEQ ID NO: 140 - DNA, 412 bp, Homo sapiens
ttataccgtgaaataaaattccaagtattcttagctctgtttttttttccacagttatttttgcacacctagcacagtgcttagcatttagtacaccttaaaaatacttgctagaacagccagggacagtggctcatgcctgtaatcccaggactttgggaggccgaggcagacggatcacctgaggtcaggagttcaagacccccctggccaacatggtgaaaccccgtctctactaaatatacaaaaaattagccaggtgttgtggtggtcactgtaatcccagctactcgggaggctaaggtaggagaattgcttgaacccaagagagggaggttacagtgagacgagactgagccgttacacttcagcctgggctacaagagcgagaatctgtctcaaaaagaaaaaa

SEQ ID NO: 141 - DNA, 429 bp, Homo sapiens
atccctgccctttcactcctttgcagcggttttctcccctaattccagctcatcgcctctcctttttcccctccatctcctccttcatctccccccccagtcttttccccttagccagatttggtccttctctgccaatctagggcgggggtgccgttccgatgtaatcatatcctcactttgcatcacccgaggacgatcaaaagctcgtcgatggtgccacaagtcacctcgagaagaggggacattgagcagcaccctgctaggcagtgcctttctggtgttctttcggttgagcggtcccggtttagattggaaatttccaggggtttcctttgccatcgcccaattccaccgctgccctcagcctggatttcccaccctgtccgcggggaaccacacccttcccttcgcgaggttgccagccct

SEQ ID NO: 142 - DNA, 1302 bp, Homo sapiens; identical to SEQ ID NO: 7

SEQ ID NO: 143 - DNA, 3329 bp, Homo sapiens
gtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggaggcccggcttgggacattgttcacttcccctcgcttcccctctagaagccccctttgccatccctgcaccttgtttcgggtgatgcccgagagggagctgtggccagcggggactggctcagaacccgtgacccgtgtcggcagctgtgacagcatgatgagcagcacctccacccgctctggatctagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggagaccatcactcagcaaggacgaacgccaaggacagtaactgagtccagctcatcccaccctcctgagccccagggcctaggcctcaggtctggctcctacagcctccctaggaatatccacattgccagaagccagaacttcaggaaaagcaccacccaggctagcagtcacaaccctggagaaccggggaggcttgcgccagagcctgagaaagaacaggtcagccagagcagccaacccaggcaggcacctgccagcccccaggaggctgcccttgacttggacgtggtgctcatccctccgccagaagctttccgggacacccagccagagcagtgtagggaagccagcctgcccgaggggccaggacagcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggctgcccctggagattctggcctgatctcctgttcactgcaagagcagagaaaagcacgtaaagaagctctagagaagctggggctaccccaggatcaagatgagcctggactccacttaagtaagcccaccagctccatcagacccaaggagacacgggcccagcatctgtccccagctccaggtctggctcagcctgcagctccagcccaggcctcagcagctattcctgctgctgggaaggctctggctcaagctccggctccagctccaggtccagctcagggacctttgccaatgaagtctccagctccaggcaatgttgcagctagcaaatctatgccaattcctatccctaaggccccaagggcaaacagtgccctgactccaccgaagccagagtcagggctgactctccaggagagcaacacccctggcctgagacagatgaacttcaagtccaacactctggagcgctcaggcgtgggactgagcagctacctttcaactgagaaagatgccagccccaaaaccagcacttctctgggaaagggctccttcttggacaagatctcgcccagtgtcttacgtaattctcggccccgcccggcctccctgggcacggggaaagattttgcaggtatccaggtaggcaagctggctgacctggagcaggagcagagctccaagcgcctgtcctaccaaggacagagccgtgacaagcttcctcgccccccctgtgtcagtgtcaagatctccccaaagggtgtccccaatgaacacagaagggaggccctgaagaagctgggactgttgaaggagtagactctgcgaccagtacagaccctgtcctggctgaacaagaagagacacatgctccacttgggagcctttgccaccacgcaactcagggctcaagatgaatgggagggagagatttgagtccaagcatacatttatattcagtgttgtgccattgagttcccatgtggatcattctgaaggtgatctccacaagagggtgtgtgtgtgtgtgtttggtgtgtgtgtggagggggggccgctggatacatcactgaagctattgatataacacaatgagtcactgttcagaattttgctcttgttagatgttttcttacattgggtagagtccagcctagtgagagctgagtgaaggggctggccatgcctgagacaaaaagtcaaatgagacaatggacgtgtcaatgacttgaaaaaaagtcacatccagcaaatgcagggtcacatgaaatatgggcctcctggaatccctacagtggatggagactggctcataccttgccagatccctctctcagttccagccttctggacaaggcctgggctaagaggagctgattcgttatctcttcacccactgccctctcagtatcaccagtcccaaagacaggatacgtccctgtaacccaatctctcggttgattgatagcagaacagctcttgttggtctgagaaggcaggataagtgaccacatatttatgccactacctccaccagggagagtccttctccacaggcttgataaattcaatcaccaactgtgctgtcgtccctgactctgctactcccgttcttcctgctttcctgctccgtatctcagtctgcactgaccccagggctgggctgacatcaagatgggagcccagcccacgggctttataaacacccaagaaccgtttcagatcttctctgtgctgatgcaggtagttttaaatttttctcagttccagtgatagaaaacccacacaatacatcctctgccagtcttaatagaatatcagaggtaagaggggcctcagagaagctctgacgcagtgctgctggggaagggaagtgactaaccccgggtcagcctgccatttagggaaagagctgaggttcttacccttgttgcatgctgccacctctccttagccagtgctcttgtacatccacacagcaccctaaggagccatagtcaccatcaaagactcaaccctaaggcccttcaagatctcaaagtgccttctgaagcatcagagattaaatattgttcaaactaaaaaagttatt

SEQ ID NO: 144 - DNA, 2184 bp, Homo sapiens
  misc_feature (2043)..(2043): n is a, c, g, or t
gtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggaggcccggcttgggacattgttcacttcccctcgcttcccctctagaagccccctttgccatccctgcaccttgtttcgggtgatgcccgagagggagctgtggccagcggggactggctcagaacccgtgacccgtgtcggcagctgtgacagcatgatgagcagcacctccacccgctctggatctagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggagaccatcactcagcaaggacgaacgccaaggacagtaactgagtccagctcatcccaccctcctgagccccagggcctaggcctcaggtctggctcctacagcctccctaggaatatccacattgccagaagccagaacttcaggaaaagcaccacccaggctagcagtcacaaccctggagaaccggggaggcttgcgccagagcctgagaaagaacaggtcagccagagcagccaacccaggcaggcacctgccagcccccaggaggctgcccttgacttggacgtggtgctcatccctccgccagaagctttccgggacacccagccagagcagtgtagggaagccagcctgcccgaggggccaggacagcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggctgcccctggagattctggcctgatctcctgttcactgcaagagcagagaaaagcacgtaaagaagctctagagaagctggggctaccccaggatcaagatgagcctggactccacttaagtaagcccaccagctccatcagacccaaggagacacgggcccagcatctgtccccagctccaggtctggctcagcctgcagctccagcccaggcctcagcagctattcctgctgctgggaaggctctggctcaagctccggctccagctccaggtccagctcagggacctttgccaatgaagtctccagctccaggcaatgttgcagctagcaaatctatgccaattcctatccctaaggccccaagggcaaacagtgccctgactccaccgaagccagagtcagggctgactctccaggagagcaacacccctggcctgagacagatgaacttcaagtccaacactctggagcgctcaggcgtgggactgagcagctacctttcaactgagaaagatgccagccccaaaaccagcacttctctgggaaagggctccttcttggacaagatctcgcccagtgtcttacgtaattctcggccccgcccggcctccctgggcacggggaaagattttgcaggtatccaggtaggcaagctggctgacctggagcaggagcagagctccaagcgcctgtcctaccaaggacagagccgtgacaagcttcctcgccccccctgtgtcagtgtcaagatctccccaaagggtgtcccccattcatcttgagccctgagttgcgtggtggcaaaggntcccaagtggagcatgtgtctcttcttgttcagccaggacagggtctgtactggtcgcagagtctactccttcaacagtcccagcttcttcagggcctcccttctgtgttcattggggacaccctttggggaggtctgacc

SEQ ID NO: 145 - DNA, 1657 bp, Homo sapiens
gtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggaggcccggcttgggacattgttcacttcccctcgcttcccctctagaagccccctttgccatccctgcaccttgtttcgggtgatgcccgagagggagctgtggccagcggggactggctcagaacccgtgacccgtgtcggcagctgtgacagcatgatgagcagcacctccacccgctctggatctagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggagaccatcactcagcaaggacgaacgccaaggacagtaactgagtccagctcatcccaccctcctgagccccagggcctaggcctcaggtctggctcctacagcctccctaggaatatccacattgccagaagccagaacttcaggaaaagcaccacccaggctagcagtcacaaccctggagaaccggggaggcttgcgccagagcctgagaaagaacaggtcagccagagcagccaacccaggcaggcacctgccagcccccaggaggctgcccttgacttggacgtggtgctcatccctccgccagaagctttccgggacacccagccagagcagtgtagggaagccagcctgcccgaggggccaggacagcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggctgcccctggagattctggcctgatctcctgttcactgcaagagcagagaaaagcacgtaaagaagctctagagaagctggggctaccccaggatcaagatgagcctggactccacttaagtaagcccaccagctccatcagacccaaggagacacgggcccagcatctgtccccagctccaggtctggctcagcctgcagctccagcccaggcctcagtgtggcgggacagccagtgctgggggtcactgtggaaactgcttcggctgctcttcagaacaatattaggtggcagcttccggggcttaggggttgtgaggggagctagtcggctgtttgggtcctcccctgatgagaggggagcatcttcagctcttgcattctgaggcaaccctgcaggaggaggctggggttgtgtgtacctg

SEQ ID NO: 146 - DNA, 1422 bp, Homo sapiens
gtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggaggcccggcttgggacattgttcacttcccctcgcttcccctctagaagccccctttgccatccctgcaccttgtttcgggtgatgcccgagagggagctgtggccagcggggactggctcagaacccgtgacccgtgtcggcagctgtgacagcatgatgagcagcacctccacccgctctggatctagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggagaccatcactcagcaaggacgaacgccaaggacagtaactgagtccagctcatcccaccctcctgagccccagggcctaggcctcaggtctggctcctacagcctccctaggaatatccacattgccagaagccagaacttcaggaaaagcaccacccaggctagcagtcacaaccctggagaaccggggaggcttgcgccagagcctgagaaagaacaggtcagccagagcagccaacccaggcaggcacctgccagcccccaggaggctgcccttgacttggacgtggtgctcatccctccgccagaagctttccgggacacccagccagagcagtgtagggaagccagcctgcccgaggggccaggacagcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggcctgggctggagctgcaggctgagccagacctggagctggggacagatgctgggcccgtgtctccttgggtctgatggagctggtgggcttacttaagtggagtccaggctcatcttgatcctggggtagccccagcttctctagagcttctttacgtgcttttctctgctccttgcagtaccacggagg

SEQ ID NO: 147 - DNA, 497 bp, Homo sapiens
atgtgagaaaatactataaagaaggaattgggctggtctgagtgcagtggtcgtttacatctaattgatcacaaccagttacagatttctttgttccttccccactcccactgcttaatttgcctagcttaaaaacaaaaacaaagaaagaaagaattggttaagcaaatattcaggaataaaacttcatgtgtcatcataaaagtaactttaaaagcaaacattttaaatatacattttaacataagtttgaggggacttatctttttcaatctgacaccgatctaaatagtttttgcttcatttacttatttatgaatgaatgaacaagacaaggtcttgttctgtcgcccaggctggagtgcactgacaccatcatggctcactgcagcctcaaactcctggcctcaagccaccctcttgcctcagcctcctgagtaactggaactacaggcatgtgtcaccatgcctggttaattttttttttcattttgtat

SEQ ID NO: 148 - DNA, 451 bp, Homo sapiens
gtctttaaggagcttaaagtccaacgaagctttcatagaaagtcacttcctatgaaaatttggtgtcgcactagccatgatgctagagttttagatcaatagttcctcagtgccatttctctgctgagattgctgcaaaagaatcacctggggaacttgttaagaacagaggttattgtggccgggcacggtggctcacgcctgtaatcccagcactttgggaggccgaggtgggtgtatcacctgaggtcaagagttcgaaaccagcctggccaacatggtgaaaccccatctgtactaaaaatacaaaaaattagctgggtgtggtggctcatgcctgtaatccttagctactcaggaggctgaggcaggagaattgcttgaacctgggaggcggaggttgcattgagctgagattgtgccattgcactccagcctgggcaacaagagt

SEQ ID NO: 149 - DNA, 377 bp, Homo sapiens
ctgtgtagcatttccctttaacatcctcctcatttccttatatcccatatataatctttacatttttaattcaatcttttgaaaagtgttgtgtttcatttaaatgtgttataaaatgtttaaggaaagaaatatgactctaaaatgttttgaaagcaggtttctgtaaagggctagctcctaaaatgacagcactcaaagaaggcactgagtagagagggaatgggagttgatgttgttagaaggggttttgccagagaaaccatttcctgcttgaaaaccactgtacgattgacataaacttatgaattatgtaagtttgttgaataacctaagcattcttgggctttttccatctgatcatggccaaaaaaaaa

SEQ ID NO: 150 - DNA, 374 bp, Homo sapiens
acttttacaaaattaagttggagatggaaaattactgtcccgacataaataaccctgccgctggatgtgacagtgttaacgcaatcaacaggatgattcataaagaaagaaatgttgtcatacttattacttctgtgcgctccatcttttatagaatattacagtgtgaattgaaattttatatgatttaataagcctcaaaaagatattatggccaagtaaccacataactgtaacaaatcgtcctcctccctcattacagagctttctccgcatgtgggactctcggcctcattatgagtggcatctttgacaatccagggcccattaaaaacaccttgaagaaagcattcaccatgctgtggagcttcaca

SEQ ID NO: 151 - DNA, 343 bp, Homo sapiens
cgtatcacttgaggtcaggagttcgagaccagcctggccaacatggtgaaactctgtctctactaaaaatacaaaaattagccgggaggcggaggttgcagtgagccaagtttgtgccactgcactccagcctgggtgacaaaagcaaaactccatctcgaaaaagcaaaacaaaaaaacaaaaaaacagcggcagcctctaatgggcccagaggataagaatggaagggagacttactatacgatacctaacatataagaggagcttaatcttccttgataatctctctctccatgaattatctttttttttttttctgttttgagacagggtcttgctctg

SEQ ID NO: 152 - DNA, 433 bp, Homo sapiens
gaagaggaatgaaattggaggtgcttgaaggatctccaaccttaaaccaatgcgagttagtgaataatatgttatcgtatacttgtaactcagtttatatagtttgtaccatactatagtaaaagtggttaagtacttcaattttaatcccactgagtttgactttaaagaatcatctctcaaaagtagccttggaaagttgttggataaagcttctatggaaatctggttgaggggagaaaaaatcagttttaaatggtggttttatgacttaaaccatcgtgttaaattttttaataaaatatttaaccacttactgagttcttcctttctggcaggtgttgtaaactctataagaaagtgacttattttgcctaccattatattgccaatcctaacatgtaatggatgtttggtaaatttttgttgaatg

SEQ ID NO: 153 - DNA, 824 bp, Homo sapiens
ctcaaaattaagagatttatatagtttctagggggaaggagaaattttagctcacttgaaattcagcgatcagtattactttagtttgttacttctaaactcttgtactgaagtatcctaatgttgagagtgaaagcatataaaatttaatctttaggaaaaactgttttgctaatcttatgggttttgcatgttatctaacatattcctcttccctacagttccctccagctgtagatctaatgccatcaaattttatcacccactttgtctggttgctgttattcactgataccattcaagttattctcatttaatgactcaccattgtcctctccaacaaaactcctctcctgtcttaactcattgtcatcttaatacacatggtgatgattcttctattaccctggtctcttgtagcttgaactcttctcctgtgtaatcttgtctttcactctaccttagccagtctttccatcttcataccttaaaccttaatgttaccaataactgcaaccctttcaaaatctatttcatgcatctactttctgaccaccacttgccatctttccagataactccctccaccccaaccctagcaatttcttgatgctaccaggatctttactccactgtttctgccaccttttcctgcttctcacccccttcatgaaaacaattctactccttaaattccctagtgaagcagtataatcactcctttgcagttaccttgcccttcacccttctctgatttcatcatcattgcttagcaaaatcaccacattaaataaatccaactctgcctacaccacacttgcaga

SEQ ID NO: 154 - DNA, 253 bp, Homo sapiens
ggcaggagaatggcgtgaacctgggaggcggagtttgcagtgagccgacgtcgtgccactgcactccagcctgggcgactgagagagactccgtctccaaaaataaaaaataaaataaaaaataaatgaactagtacagttgatggtgatctgcaaaaccaaaatcatatagttattttcataaggaaattctaaaatgaaaatgggttagactgattcataatttaataatctcaaataacaaagtgtgcta

SEQ ID NO: 155 - DNA, 483 bp, Homo sapiens
gtctgtcatatatggtgcaattgaaaacttctttgcttcagttttccttctgacacattaattacaaaaccattcccagttcccctggaaaaccaaatgttttataatttctaattctagtgtgagctcattagcttgtttgttatcagattgactgcatataggaagttggatgataacagaaacgcaaaatgttggtccagtttgtttctgcccaacagaacttccaagactttgtgcctgcaatttgagagagcaatttgagagtcgcaccaggatatttagtccacagtttgatttacaaagcctacttacaaaatttatacggaacctgcaaagaaattagagtggacatggagaaagcatgcattcagagtagccacattaagttaggatccatgggctctatttccaaaaggattaggttttaaaaaattaaaatccaagtccagtaagaaatattttgtgtgacttgacactcct

SEQ ID NO: 156 - DNA, 280 bp, Homo sapiens
ccaaagtgctgggattacaggcgtgagccaccacgcccggccatgcttgttttttatccctctcctcccactaggacgaagctccatacagcaacgtttgtctgttatcagggatgcagctagtcaactgtaagcgctgttgaatgaaccgtttacaggaagacatttccactagatactacaagtgccgtgtgagaaaatgcactttgcacagagaagtctttctgccttctttccctacaagagcttggggctacttgatgagctccactctcagcaa

SEQ ID NO: 157 - DNA, 343 bp, Homo sapiens
tggaatacgggctctttggggagtctgtctgcaaggcgaggttagaagcaggagcacagggagaaaatgtggcagccaaggttctggcaggaaacaggtggaatctttcgacgggaatttgaagagtagtattaaagggattatttacaaatgtggggacaggatgtagggatatcagagagcaggggcagcactggggttagtcatagcaggaagctgttactacctctaagcgcaaatgggcaagggaggtgagaggttcccagaaccacaggatagggagggtgagtgatgggaacctgcggacaggagctgtggacctcagtggtggggaccagcctgc

SEQ ID NO: 158 - DNA, 104 bp, Homo sapiens
gggagatatgaaaagaagcagagctggctgcagcagggtgagagcatccagccaacctggcccctgtctatgctagactcagcccgtctatgctagcatgctgc

SEQ ID NO: 159 - DNA, 396 bp, Homo sapiens
ttttattttattggcagagttcatgtagctaaacccctcagtgcttcaatttaagacatcgggagatgaatgaaattgttatgttattaagtagatgctgcagctctgcttgctagggatgaaatcctattttatgaaataatatagtgtgaagctgtcagtaatttccaattgtagaagaggcctaatcagaaagttgggttttttttgttttttgttttttgttttttttagacaggcccagacagttttttgaccagacatctatacatgtttcagtgagttaattactcattttattgtaatttcatctgttagaaagtacccaaataattgcaaagtttatgtatataaacttttatggatatatcacaggcaaacaataggtgatctttg

SEQ ID NO: 160 - DNA, 671 bp, Homo sapiens
ggcctgaggcagtcacctatttgtagaactcaattgatccccaacctgccaggcttcctatctcataggaaacatcctcattgatcctcttcagttggagtctcccaaatttaatgtggaagacaaagtgttggaaaatcaaaagaggctcactcaaaccagcacagggagtcctcagagttgcagttcaattcattttaattagaaaagtatgaaagaggtataacactcttattctagcacagtgccttgcctagagtagtagtatgaaaactatttgttgaagaaataaatgaatggaaagacatagggaagaatgggctgtaaatcctaattaaaaatagaggtcgacatgagatacctggcattttgggaagtgaccaaagatggccagctagagattcagcatctccaggatcctcatgtgcctctcctcaaagctccctcccatctgtaggagattagtgaggcaaggtgctgctcagagaggaggacctcattgttcttaggaccttggccagttgttctcaaagtgtggtacctggattcagcagtatcactatcacttgggctagtttagagatccagattctggatccataccccatacctactgaattagaaactctaggggatgaatagtggtgttctctgttgctaagtgacagtgg

SEQ ID NO: 161 - DNA, 444 bp, Homo sapiens
gatgcaataggttgtgtttcagacatcacaactcttcatggaactgagttttagtagcttttcctcattaaatctttctcatagggctgtatgtccttaggaacattttcagagactttaaatggttgttttttaatacttttcatcagtttcactagggagtgttccagggaacgcctcagactgctatgctagagtctgtcctctcaatatttaggaagcttcttaaaccttaattccaaaattctgataaagatgataccaaaatgaaactgtagattagtttactattattaaagatatgaaagtgggctggattggccgggcgcggtggctcatgcctgtaatcccagcactttgggaggccgaggcaggcggatcacgaggtcaggagatcaagaccatcctggctaacacggtgaaaccccatctctactaaaaata

SEQ ID NO: 162 - DNA, 481 bp, Homo sapiens
attcgcggccgcgtcgacattctttaaagacttaaagaatcgccatgatgtgtgagattttaatggataaatattctcctgaaagctacataccaagtctaaattttgataatcataactaaaggacccaggcgtggtggctcatgcctgtaatcccagcactttgggaggccgaggcaggtggatcacctgaggtcaggagtttgagaccagcctgaccaacatgatgaaatcccgtctctactaaaaatacaaaattagccaggcatggtggtgggcgcccataatcccagccactcgggaggctgaggcaggagaatcacttgaacctaggaggaagaggttgcagtaagccgagatagcaccattgcactccagcctggacaagagagcaactctgtcccaaaataaataaataaataaaaggtcgacgcggccgcaaatttagtagtagtagtcccccggggaatttcggaccggt

SEQ ID NO: 163 - DNA, 446 bp, Homo sapiens
gacatgtgaagagggaaggaaggatccagcttcggggggctttcagactggcaggagatgacacgcacacatctgaaacaacccgtgcccagagaaagtgaaaagggatctggtggcaactgaatacgcagttcaaagcagtcattgtcataggcactttccctgcctgtcctgcccatgctccttctagggaacatgccctgctcacagctgttaaaggtgttgacccatgacgtccaggcccatccccatcccactaaaaggtgttaaaacaaggaatatccactaaaaggtgttaaagcaagggtgtgtctggtctcatcgcctgattttagtgcttttaacgctaaaaggtattaaaagcaaggaagattcactaaaaggtagatgggaccaaacatgcccttgctttacaccttttagtggatcttccttgctttcagatt

SEQ ID NO: 164 - DNA, 369 bp, Homo sapiens
ctttgttcttgggggaggcggttgtgatgagttctaaatataaacatcactgagcatcacattttatgttgaaagtggcttaatgaaaaatgagaaacacggaagtaagagtgagaaaggaaaaagagtaaagtataaatttgtagcctgaataagttataccaaaggctatttataatgttgtctatgtacccatgctatgaaattatacttaaatccactggagctctgaatcacagaaagcaatcttatctgaggtaataatataaatgtccaatttcacagataaaggagggatgggattttttaaagatcactttccttaatgcggcctaattaagggtataaattaaaaaggtttttgagtta

SEQ ID NO: 165 - DNA, 358 bp, Homo sapiens
tgggagtggatgtgtcagtcagggaatgaggagcagggcctggaaggagcacacagtagagccaagcccccataaccgggggcaagtctgcaccatctctgacctttgtcttcttgtgtgtgcactaggttagtctagagcagcacttcccaaaatgaggtcccccagccagcagcatcagcataacctggaaattgttcaaaatgaagttccagctaggtgctgcagctcacgcctataatcccagtacgttgggaggccaaggtgggaggatcacttgagcccaggagtctagtctgtctgagaccagcctgggcaaaaaagccagatattgaaagaaaagaagagagaagaaaag

SEQ ID NO: 166 - DNA, 469 bp, Homo sapiens
catacctcaaatgaaagtttcttttgttgatactgtcataatcagttgaaaagcagtctaaaatgcaatgccatctgttgaaaaataaaaatgaaattgttcatactacatatctgggcagattttcttaaaatggtgcaacacaaaatagagaaatcatctgaatgctaaggttgttttgtattgtcattcataatatcaaattttacattttttggctaaatacctgcattattttcattgactttcaaaatgtcagttttatctgttttacatgctgaggttctatacaagatctcatccaaagaaaatgttctactgttgttttttttttaagtatcaaaacctttattgcaaccctttactgctcaaagttctctcagcaaaactttgtgacaatgcagacatttcctttccctgaaggtccccactttaatcagccttctcttgctggggccagtctttaatc

SEQ ID NO: 167 - DNA, 461 bp, Homo sapiens
cttttgcatgtgatttgactatgcgctgaggacctagcgtggtatatcagcaaagtggaaaagtgactgaagtgactgtttatcatcttgtaccaagttacaccactttaagctttaactccacagctcttgcattattttaaaaccgtctggcagatctctaaaactaatggtacaaaccactctgtgatacattaaaatacatcccactctgtcatactgcaaacaagtagctgctccccagtctttgaaaaagtactttcaagataaaatatgtactcatgggttctgcaggtttttaaaaagtcttgaatcttcacagatttactgggggggaaggggcgtttcatgtaaaatgtgtttttccttgacatttagaggtcttgcaaagtggtttattatagatcttgtggacatctcgctatttaattaaatttcagaaatatattctctgcactcat

SEQ ID NO: 168 - DNA, 460 bp, Homo sapiens
ttacctaaagatttttccttgctatcttttccaaagggtcattttagagaatggtgtatctgaataaacttttaatttatttgtgtctttttctccataaaatatgctcagcaaaagaaaggacgtctaaattggggtttgcttggaattgtatggagacattcttgcaaagtctttggttgagggctgaatatcccactttcccttggatgttcaggagtctaagagtggagttgaaagtaaatcatatgtttctgaggagattatcattgacatttccatattttccctcagtttctcaaatgtgccatctaattctgcagcccacagattattctgaatgatgttcttccaaaagggcttatctgagtaggtgctatgggccagcctgtttcatcttcatgacaatccttcgaggtatgattttagccacatttttctacaagaaggggactctgag

SEQ ID NO: 169 - DNA, 823 bp, Homo sapiens
atactggtagtataacagttctttccaagcttgagataaaaatgatttcaaatcttgaatctgtaaacaaacaatcaagtcatggtaggataggttgtcaaaatgaaaagattcagaaagtttacaaccaatgggcaccatatgaagaaaactgagaatgtgcaaggtaaatacagaagatactggaaacagtaaggaccaggatgacccaggtgacacaattctttagctgttactgtacttgattttacaagaaaaatacttatgtgttcattacaattacattgtaagggctgtttgtttttagttttaaaaatgaacctaaggcccagagaatataattttaggtactgatcataatgtaaactattataaacttaacaatgtaagaaatcataacaataaaatttcaatttaaaattcttgtagtttgtcattaaattcactggttctgtgtgactttctcctatggcctatgttggatatataagagccaagtgttatccattcagattgcttcaatcatcatctcttccagataaatgctgagtcagtattttcagctcaaacgtcactcttagactccagcttatattttagacagccagctgaatgtcttgctctggatgtcctaccagaatagcaaaattcaacatgtctcagtctgaatccatcatgtactccctcttaaatgctcaacagccttttccttatgatgcccctatctctaattaaccctaccacaacttaatacttagtctttgtattagttagagttctctagagggacagaactaataggatagatgtatatatgaaggaa

SEQ ID NO: 170 - DNA, 362 bp, Homo sapiens
aagtatgctagggtaaatgattgatagttcattatcatagaaatattatattccacatagtttactttaaatattggcagcttgaaatttggcttagcaaattggcagcttgaaaatccctgctttattagttagcaaatgattctgagttttatcacattttattgtcaatctcagtttttaggtgcctaggaattaaaaattatatgctcagctgaccctttaattagctctcattctgtcttacgtgatttatagcctggtggcttacatgtaaaaatgatgtatgatttaatgagctggaaaggcagaatagtttcccacctctgatcgtttaatgcttttctctggctggtgactgg

SEQ ID NO: 171 - DNA, 400 bp, Homo sapiens
gtcccagctacttgggaggctgaggcaggagaatggcttgaacccgggaggtggagcttgcagtgagctgagattgcgccactgcacttcagcccgggcgacagagcaagactcggtctcaaaaaaaaaaaaagaaaaaatagatgagcatggtggtgcgtgcctatagtcccagtcctgctgaggcaggatcccttgagcccaggagttggaggctgcagtgagccaagattgtgccactgcactccagcctaggtgacagagtgagaccctatctcaaaaaaaagaaacccaagacatgtattaacctcatttaatcttcacaatgattccatgaagtggttctattaagatacatattttggccaggcacggtggctcacaccaacacttgtgagag

SEQ ID NO: 172 - DNA, 393 bp, Homo sapiens
ttttttttgttgttgttctctgggctgagctgttgtgttaaaaagttgattgagaaataaattgccttgagaagcaatgagcaatcagaagtaactggatttccaaggtcacaatggggcatgacgtgcccagaccgcaaaggggcagtgtggagcaggatttgttatttcacaattaactagatgtgagaagacaccaacctgatactgtattatctcatttgctgctgattcaagaatggaatgatatcaaaaatgagttctaaaagaaacagcacatcagagttggatgtaattcccctgctgagaagctgagcctctgctataataaaagctcctacaatgacagctgctcatttctgctggtccagggctgttatcctttattttttg

SEQ ID NO: 173 - DNA, 469 bp, Homo sapiens
tcacagatccacactgggagctggctggggtgacctctcctggactccatggcccgagagaggagcaggtggaagcagtagacctctgcagctcatcctcctctctccttaccacctcctcttcctctgagccctttgttcttcccccagtcctctcctgggccttgggataaggctgagtgagctgggccttcggtgaagctgagtgagccagtaggagctggctctagccacgtttgtttgttgcccttgggtttgaggccctgcgcctcaggctgcctcttacggccatgctgggagctgatgacacagttttggggacatgaaggggctgctcagagcgggcacctttggacatcctttgagtaaatgtgattgcaggggcgagagggaggtgaggcatctcgcggaagcccaggcttctctgcgccaacatcctctcttctaggaagccttcgcttggggcccc

SEQ ID NO: 174 - DNA, 431 bp, Homo sapiens
agagtgtcaaacagtctgagagaataaatgggggtcttgtcttacattagggtgagagtttgattatttaggatgatcccagtgatttcatgtgtgctctctgacctctgagtatcatagtatcattaaagtaaagatttaagtctgtataaaggaggagagttactgattggcaaaaaagattggcacaaagcatgaagaaaccccatttttcccagggtaatcatgaaagaaggctcagagaaagagggaaacaaaagcctgttcagcagaggcccctttagtattatggactgggcaaagcccactataaactataggagaaagaagttctgataaacctcttagtatgctcagcctccttctttgctatgtccctaagccaacagggtataacacaggccctggtgataatgagggtgtcctaaaga

SEQ ID NO: 175 - DNA, 434 bp, Homo sapiens
cttacaaagtccctgcagcctcaacctcaccgggaagctcatatggctcctctgctgagcaccaggtcctgtgcccacctcacagcggggaagccaaggaaggagatgacgtcttccttgagctttcaggcagtttgtctgcctttaattattctgacattgtagggaaatcatcaagttatttgaaaggaacaatatttgttctgttttgttttctttcttaagcaaataaacaagccaagtaatttcctgtgatatcacccactgtggtgagacagtatcaggtgtgagatcacccacttagatagccttgaaccctcatgaaaccaggagggtcagctgaccctggggaagtcccattcctcacaatctccacccaggaacccacgcccccttgcccttccagacagggatatgtccccctccttgggctg

SEQ ID NO: 176 - DNA, 781 bp, Homo sapiens
atatctgttgctgaataataactctttcaaagcattaatgctgagtttatatagttcaaaaattctaatattcattcagttttaatacctaaatacttatattttactagtgatggcattctaatatattaagtcctcatttaaatacttgatactttgttaactgtggcattatatttctgaattttaaaacctttaatatgtggtaactattgcatattcttttaataaaacatgcagcatatttttttataaaaggaaaagaattcattgtttatatctagagagcataaagcctaagttaagtaagttattaaacaataacttcacaagatgttcaaatcgatttatcactgaaagaagatctatgaaaatgtgttttgaccaaacttagtattaggcaggtacacagataagattttccattcttaacattctcactgtaatgcacgacatttgaagcacctggatgtgctatcaatcaggtgggaaatttagcattatatattggaagcattgagaaacattggtctttcatttctatttttttttcccctcctttcctcctcctgccccacaatatattattcatctggttttaatgctacataaatatgcattgtctcatgcctgtttgtgttggatgccttgtgctaagctgtaacaaaatgttgcttcttttgctgtctgtatacagctgcttgctttaaattagtagattctgaaatagctttccttgcatgtctaaaataaaagtattgcatgtaaaaaaattcgtctc

SEQ ID NO: 177 - DNA, 378 bp, Homo sapiens
catattttctaatacttttttctcattaattagattttctcatcctgagtctcataattcaaagacttcggaaaactgggcataaagaagaaaattatttcatgaaaacacaaatttggttaaacatgcttatgccatttttttttgcataaaatgcaaagtaaaaatgctatgatccaaatacatgaagctaaaatagtacctaatcacacttttcctttttgaaatatcatttttgtatatttaatgatggggttctactttagtattatagttggccaattattgttcactttaatcctcgccctaaatttcataaacataagtggccattactggtcactatctttcagtgtggaggacacaaatcagtagagt

SEQ ID NO: 178 - DNA, 421 bp, Homo sapiens
cagatgtgtatgaggtacaggtattgggtgtgtgagtgtgtatggggtgcaggtgggtgtgtgggtgtgcgagtgcatgatgtgtttggtgtgaggggtcggggtgtgggtgtgctgtggtttttgtctccaccaaaatttaagcgtcataaccgaatggccagtgtgatggtgttaggagtggtgaggccgtgaaggggatgaaggtccttgcagaccaggcctcagtcagcagagacctctcaccctcccagcgcctccacgtgagaacacagtgtctgtcccctccgtaggatgcagcagaaaggtaccaccttggaagctgagcgcccccctcgccagacaccagacctgctggctcctgaatcttggacttccagcctccagaatggggagaaataagtttctgttctttaaaatt

SEQ ID NO: 179 - DNA, 1125 bp, Homo sapiens
agagatggggtctcgctatgttgcccaggctggtctcaaatgccaggcctcaagcaatcctcccatctttgcctcccaaagcactggaattacaggtctgagcaaccctgctggctgtatagatctcctttcatattacctagtgactagttccttttttgcctctgtggtaaaatgtagtatcactttgtaatgatgtaataagataaaatatttaacctgatattatataacagggctgctggaatgttgggctttttgtcattaagtgtggtgattttgtcatttgattacttgttttagtataaatgttttatgcagttttatgtttctgtagtgtatttcttaggcagttaaaatttttacctgctattaagtaaaaattttaatttatgtgtttttaggcattcattgttaatgcttaaccaagatattcagagcataaaaatttgggtcattcaaaaatcttaatctgataagcaacttcagcaaagtctcaggatacaaaatcaatgtgcaaaaattacaagcattcctacacaccaagaaagacaaacagagagccaaatcatgagtgaactcccattcacaattactacaaagagaataaaatacctaggaatccaacttacaagggatgtgaaggacctcttcaaggagaactacaaaccactgctcaacgaaataaaagaggacacaaacaaatggaagaacattccatgctcatggttaggaagaatcagtatcgtgaaaacggtcatactgcccaaggtaatttatagattcaatgctatccccatcaagctaccactgagtttcttcacagaattggaaaaaactactttaaatttcatatggaaccaaaaatcttttttttgcccacattgccaaaacaatcctaagccaaaagaataaagcaggaggtatcacgccacctgactttaaactataaggctacagtaaccaaaacgcatggtactggtaacaaaacagatatatagaccaatggaacagaacagagcctcagaaataacaccacacatctacaaccatctgatctttgacaaacctgacaaaaacaagacatggggaaaggattccctatttaacaaatagtgctgggaa

SEQ ID NO: 180 - DNA, 437 bp, Homo sapiens
cctttcctcacaactctgcccctcttttatgcccccaaaccagaggcaagaagtagaacaagaaagaaggtggagtagaagcaggtcttttctgcaagactctggatatggattcatttcttaaaattacctcaagtgacttcctccctcacccagtcaacctgaaatctaggaactcaagctgtattacagaattaagggatgatgggcaattaaaactgtaatccacctagacagaaatatgacagaaacattagtctactgatatggggttaagtcttgtttcatgacacaaagttatagaaagtgcctccatgcctctgtattggcagaggatatagaatttcccaccctcttctccagtcctgactctacatcccaaacaacaaatgggtagtaagtaggggaaagaacactaaatcctttgttttcacttt

SEQ ID NO: 181 - DNA, 344 bp, Homo sapiens
ccagctccaagccccgtggcacctcccggcttgtctcaggccaatccttgaagagctccagcagatctaaactttggtaactttcctctggtaatttgaggaattcctccatttgaggaatgtcagaatggggccaggattcctgaatgcccatggaagaaaagcgagcatgctggtctggcgggcagaaataaccttctccccaggctccagagggcagaggacatttccctccaaaaggcaagtttctcagggacctcatgagaagcctgtcctcacctgagcagttctgtcaaccatcccatcccttcacctggaccccaggtccccagcaggccttttta

SEQ ID NO: 182 - DNA, 438 bp, Homo sapiens
ttgtaatataattttgaaacggccacttcatttgagaaaaaatatctttggttgctatttttcaggatctcatttgtaaagcaaagtcaattttaaaacattttctctccaaaccaaagtaaagcattaaggacctcccaaagtaattcttatatatgaaaaaagtatgtttatgctattttatgtagcataggtttatcatgtgttacacatttttattaccttattttacttgttagtaaagatataaactataaagatataatacaaaccatgtttatatctttgcattatgtttacatctttactttcaaataaatctgtcttcattaaaaattctagcattcagagttttactaagtcagactggcctctcttttatattaataattttcaagttttattttattggactagttttccttggggagataattc

SEQ ID NO: 183 - DNA, 592 bp, Homo sapiens
ctccttaactggtttctccatgttcctccctatccgtcctttcttcacacaacagtcagagtgatcttttaaacatgtaaatcaggttgcccctgtgggcttggtttgtgaggaagagcctggctcagcctgtcaggaccactgaggcttgtttcttgccatcctttccacctcagttttacacacttctcacctccagctggctgggtgtggggaagacctgccagagccacattggacaaggtggttcccattgccaagtagatggacaagatggtgcagaagaatacagctggagcattggatttgccaaaggagcttaaaaatattcccatgaccatggaattattacagcccccagaagaatcagaatatcagttaatgctaatggcaagcagcataaagatgaagaagttacatctttaacagtctgtcatgaaatctgggaaaaagttactatcaaccgagaaagaccctgaagaaaagaaaaaagaacctgcagttacattgcagaataactctgaagcgagagaagaaagtagctccggtggcagtgcaagcagcagagagggtgagacaaatgctctagata

SEQ ID NO: 184 - DNA, 319 bp, Homo sapiens
tgcctagtctctcccacttaatattcacaactcccctttgagatagacagcagtatactcatttattattgaaatcctcatatattaataaccagctcaggacaaagttctaggatctcaattcttcttactccagtcatgtgattcttataatatataataatactttaagaatccatcaaaataatgtgtgcatttaatgcatttgcctatttatggtgtgaacatttaaaacatatttttgccaggcgtgatggctcatgcctgtaatcccagcactttgggaggctgaggcaggtggatcccctgaggtcaggag

SEQ ID NO: 185 - DNA, 262 bp, Homo sapiens
ttgtcagtttaaggaggcagggacagataatgggatcagttttagataaatttgcattagagattttgaaagtttggcacttgaatatcgagtattttcaaaaagttctttatgttgtagttatttctgtgggaatcaaagtggtatttctatgacatattttgatatccatttttatattatatccattgttatgagttaattccaggtatacaaaaatcaacatgaacaaaccattgacaatataatatatccctgtatt

SEQ ID NO: 186 - DNA, 299 bp, Homo sapiens
tcatggtgaaaaatatcaccctcaatctagtgatccaagtcagaaaactgggagttatcgctactctgtttcatagaaatccccatccatcaagaaatatgaaagttaaggctgtaatatgaaatattacagtcactcactcctgtaatcccaacactttgggaggctgaggcgggaggatcacttgagcccaggagttcaagaccagcctgagcaaccaggggagaccttgtttctacaaaagaatttaaaaattagctgggcgtggtggcatatgcctgtggtcccagctactcaga

SEQ ID NO: 187 - DNA, 359 bp, Homo sapiens
tgtgctgtctgcaactccagttacctaggaaatgacagcttttcatggggtcagagggagtggtgctgatcagaagggcccttctcctgtgactgtggaggctttcacacctgtcatcactcctgtgatgtcccaggctcgatgcagccctgtgtaggtatatctaccagccaagctgatgccaaccagccaagctgatgcccgcctctgatgcctggacttgttgaaaatgtggtggaggctgggcatggtggctcatgcctataattccagcactttggaaggccgaggagggaggatggctggagcccaggagtttgaggacagcctgagcaacagagtgagacactgtctctcca

SEQ ID NO: 188 - DNA, 400 bp, Homo sapiens
gctgattataatctaattactaaactaccatgcctgtcctgccagtccccccaggcctgacctcagccctctgctgggctttccttctcctgggccaggtgcattactcacctcaagaggtacttgcacaagaagaacatattgacaagagaaaattgcccaggagccattttttaaaaatctgtcttagacattacttctaaaattggctgcctgtgtgctgaagctaagatttacttcagcgaacacttcgttgcccatgtttaaaactgccccatgttagggttttaggttgaacaaccttaacctttattgtgtcccaattacacgtggtctgtcatcttgtatatatttagtattcttgtggtttataaatttgagtactgaattaaaatgctga

SEQ ID NO: 189 - DNA, 340 bp, Homo sapiens
gtaccactcaatgataaaaggaacaagctgcctatatgtggaacaacatggatgcatttcagaaactttatgttgagtgaaagaataaacacggagaacatactatgtggttctctttatgtaacattacagaaataaaaacagaggcaaccacctttgaggcagtatggagtgagatagactggaaaaaggaaggaaggaaactctacgttgatggaaatgtctgtgtcttcattgggtggtagttatgtggggatatacatttgtcaaaatttattgaactatatactaaagaactctgcattttattggatgtaaataatacctcaattaaaaagac

SEQ ID NO: 190 - DNA, 435 bp, Homo sapiens
tgaatcatgggagtgggtttttcctgcgctgttttctcatggtagttgagtaagtctcacaagatttgatggttttataaagagcagttccactgtgcatgttcttttgccttctgtcatgtaagtcatgcctttgctcctccctcgccttccaccatgattgtgaggcctcctcatccatgtggaactgttagtccattaaacctctttttctttataaattacccagtcttgggtgtgtccttacacagcagtgtgagaacagactaatacaaacactgaccatgaactccttgggggcaagaccactatctcattggtctttgtaacctgtctccacacagatactactggttagagacagtatccatacaattcacttctgtatctcaactgcccagcagagtgttaagtgcttcatacatatctgctgaa

SEQ ID NO: 191 - DNA, 442 bp, Homo sapiens
aatataagagctgaaagtatttagataataatttcactgtttttgttttgttttgttttgttttgagacggagtcttactctgtcaaccaggctggagtgcaatggcatggtcttggctcactgcaacctctgcctcctgggttcaagcaattctcctgcctcagcctcccgagtagctgggactacaggcatgtgccaccacatctggctaatttttgtatttttggtagagacagggtttcactatgttggccaggctggtctcgaactactgacctcaggtgatccaccagcatcggtctcccaaagtgctgggattacaggcatgaaccacagcgcctggcctcatttcactgtttattgaataatggatgttaaaaaaggatggaaagaaataaggataggaaaagacaggaagaaaggaaggaagacagggaaaga

SEQ ID NO: 192 - DNA, 293 bp, Homo sapiens
gcaagtcctagtgctgtgctgtgctcaacgcctgtggacttgcggcgccctcctacaaccccagcagtgcagctcccagctccaggagagactcccttctactccttgaggaaagaagggggctttgtcttgcaatttggataccagcacagccacagtagcgtagggcacaaagcagagtcctgaggctctcactctaggtcttagctctcagataacatttctagacacagcctggatcagaaggaaacctgctgacttgaagaaaaagagccagttctggaagaatccat

SEQ ID NO: 193 - DNA, 280 bp, Homo sapiens
aagactgtcctggggagacgcccccccgccgccccggcaccccaccttcttcactctgtgaggagcaccgacctctgagttcattccacctcctacaggcaaagatttacaaaatggccaataaacataagaaaaggtgctcaacgtcatgaatcatcagagcaatacaaattaaaaccacagtgagtgcactacacgcccaccgaaacgggaatgtttttaaaatgaccataccgagtttggcgaggtttacacgcgggcgggcttgtaaactctctca

SEQ ID NO: 194 - DNA, 577 bp, Homo sapiens
aaacaaggaccgtcgacgtccaggggaatgactgtgcaaggtagtatctaagcacctgagaagcagtagtgctttgtcgccggctcacggactcccatgcagccttcctcaccaatttggcacaggcagcagtctccctcccaggctctccccatctcccctgctttggtgttgagtgatgagctgagtcagggatagggagtcccctggtgctaaccgtgaacgtagagacttgttctgaggacatccacacaatagtaggaatctccccaaccaatctgtgaatttcatgggggccaaaactgtattttgctcactgctaagtccccagctcaccttaggggctcagcaggtccctgttgaagggaggaaggggaggagagaaggagaaaggcaagcaggcagacagctatgggtctagcatctgcagtgtgttagcgttggggaaacagaagaactagaaggatggatatgctgatgactcctagattggaactccggtccggttctttctctggagctctagatactcactttttgtgccccccaaatgaatgcattttcttcccctaaactt

SEQ ID NO: 195 - DNA, 355 bp, Homo sapiens
cagttgattagttgaggctagaacccatgtccctgtttagtactttgctttgtggtgtgattctgccctctgtactagtgctcagatggtgttctgtacttagcaggggcactggagactgagctccaaaccatttattactaaagcgtatgtttaccaagtcctttttggttctgttatttattcctgtactcaactaagccaaatctagatttaattgaaaactgtatagacactgttaattccaagtgtgctctccaggtcatgtccaatgagggaggcaccttagtctttcagagacgttttgataaacatttaaagcttaccatagttatttgcttgacttaacaccttt

SEQ ID NO: 196 - DNA, 318 bp, Homo sapiens
aaacactgttctccaaagctaggttactatagtatagttaatatattttcttcctcaatccatttagtgtggtttcctcattcatttgtaatacagctatgcttatttattagtgcttatatttcattttggattctgcacacatgttgattgattttgattatttattgggagaacgtgaaatattactgattataagagtgaaagctgttatacaaaaaggcattctacttggtttaacaagtccaaaagagaattcctgattttcttccccaaacctgctttttcacctaaccttctttatctcagtaagtaaca

SEQ ID NO: 197 - DNA, 522 bp, Homo sapiens
agaaaaacacgctaaggttgtaatacccaaaactgctaagaaaccctgagctaccagagagaactaagagaacttacagaacactctaaaatttgaaggagacacaacaacatccatctgttggacaccatgctgctactaagttgttgaacctgactactaaaaatgggaactgttagataatatttctggtctagggactctccgaaaaaattaatgagacagttaaggctccatgaactaaacaagtttggaaaccactgctgtaagttcatcagccatgtagaaagagataagatgcatcataaaagttcaggaccaggagtgatgacagacagctggcatttgccagttagcacttaagagggaagagctagaccaacagggatggcagactcctctaaggggaaagtcagtctctgcaaagaatgttgcttagaattagtcttggtgcggaggttgcaatgaccttgattgcgccactgcactccagcctgggcaacagagcaagactccatctca

SEQ ID NO: 198 - DNA, 311 bp, Homo sapiens
tatatccttaatttatttcttattttttgtgtgtccttccaaattcatgctggtatttttaaaatttttaaatataaagtattaatagtttataattactccatgaacatcaaaattatcactttcatacaaaaaaaatctcttttgacacatacaatccttgaaagtattttcttgagaaacataaaatatataatacaggacttatttagcaaatgaacctatgacttatggtctagaattccagctaatttaaatatgtaagactcaactataaggaaactgaccaatgcatactccttttgagatgg

SEQ ID NO: 199 - DNA, 351 bp, Homo sapiens
ggttctggaaagtgagcactagtaatggacgtcatgtggtagtgagtcctattggaattaaagtcaatgtcatcctgtctcaccctagtatagattttttgtttgggatcgcagttttcctaaacatattgctgtagttcttaagttgctggtgtggaaaatttttggtcacgaattcacacttttacttacaatttgacagttaaaacagtatagaattgtcacataaagggtaaggtagaatgtatcacaaatgcaatagtgataatataatgcctttattgcagaatacacagattgagactttgtaagattgcaccacaagtcattcactttatagcagaaaaaaaa

SEQ ID NO: 200 - DNA, 401 bp, Homo sapiens
atttagtgtaatgttttcaagttcatccatgttgtatcttgtgtccaaattttattcctttttagggtgaatacttttccattgtatgtatataccgcattttgtatccattcatctggtgacagacgtttgggtcatcttcacctcctgacgtttgtgaataaagctgctatgattactggagtacaaatactcatttgagtttttgttttcagttctttgggatctatacctagaagtggaattgccacatcatatactaattctgtgtttaaactttgagaaaccaccaaattgttttccaccgcagctacactattttacattcttaccagcagtccactgagtttccaatatcttgtagcccacacttaccttctggcctttatattttggttttt

SEQ ID NO: 201 - DNA, 422 bp, Homo sapiens
gggtatttcatcaccgtaatttaatgttaaattgaatttcaaaaaccttcattatctgcaaggtttttgttctgttcgtttaaactttgagcagcttccaacttaataacacactcttttttaaactgataatggcttgcggcagagtaggaaggtagctaatgcacagcaacctttaactaagtctgacttcatgcatttgcatttgagaagccaacatgaagagcaatcacttttaataaatgatagttaaagccaattacaaatttgctattaaagtcacactaattccactttgaagctgaaaaatttgatttcattttcaagacaaagcacactcacgcctttctggagctgcaaaacacatttcaacagctctgtgtgctcatcttttttcactgctacttgagtcagaatcgcat

SEQ ID NO: 202 - DNA, 159 bp, Homo sapiens
aaatttaagtactgtatatagaaagataccactatgatacataatgttttcttgtaagttccttgaaggtaggactttttttgtttttttaaaccattatattcccagagcctttatatatccctgtttatatatcccttgtatataaatctttgttgg

SEQ ID NO: 203 - DNA, 386 bp, Homo sapiens
gtggggtggcgggttccccaaggacaaggtcatgctgtcccttttatctcttcacagcctgtgtgcagggaggccagggctttgatggggtggagttgggggcggacagagtgtggatgcattgcacagcagcaagtttgcccaggaggcaggagtgccagtgcctgccatccatggggttctttgtcctagacagcccttggggtcccggcatggtgccagcctatgagctgaggcctctgcctagaaagtcagtgttatcaggccccaggctggtcctggtgcagtggggtttgtctttgttcagccccattgtaagacccctggcagtgacctgttggtcacctttaaggcatctgctctttgggacagacagaggacttttc

SEQ ID NO: 204 - DNA, 236 bp, Homo sapiens
aaatgggtcaaaagataatatcaaagaaaaattcgagaaaaaactattttatattcataaaaagtataattcacaatgaagctttagtagtaataaatctttatatttgtataatatgtcattgaaatctatgaagtaaaactaccagaaatatatgtaaaattggtggaaacaatcattatgagagattgcattaagtctgataatttgcataagcaaaatgtatggagaatttg

SEQ ID NO: 205 - DNA, 360 bp, Homo sapiens
aggtttgtgtccttcctttcagggcaatgagttcccccaggccccgggcaggaccaggcatgctgtctgggagccaaggattagagtcaaataccttagaaatttacctgaagttctattctactgcagctaagctggcactcagaccataatccagaatctttgttgcacttccctcccctctccacagggagaagggcctctccctatagccatcagcaccagcagcccatagcaggggttctgccaggccactggcaatgttcacttaaagcccagtggctcttcagtcaacaagtggtgaatgctgccaggctgggaactcgttcttcagagcactgggctcccatatgccccagg

SEQ ID NO: 206 - DNA, 1792 bp, Homo sapiens
agcggatggctctgcccacggatgacaactgtgcagtttgtcttccaattaactaagaggtactctccatccctcattagcataaaagccctataagtagcagaaatccgctctttactttcgacacatttctggtgttttaagatgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacaggtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaaggggagacaacagcttttagacatatcttttccaacagtcgtcactgctggacactgtttcatcttgcaaataaaccaatgaaaatgagtgatcctagaagaagataaatggaggtattttgaacaatcaaagaaggacaaatgaacacctggctgagaaaaattagctcttttttctatgcataaaactattaaaatattcttcatagaaatttatgacacaggaaacataaagacaaaattaaaataactcctagtatctcctattctttttatatgtatattatatatactcatattcatatatacatatatctcacatcatgtatcatatataaaataaatttaggtgtcatgatatatatttagataaatatacttagaaacttttttatggatgtataatttatggatatattgataattatgtatttgttattgactacttcaattgattcccatttttatgcattatattatagattatatagctcacacatctttgtacataaatctttgttcaaatattatttcctaaggatagacttcatgaagtggaaatactaaatcaaaagtgaaaaacattttctaaggttcttaacatatacattgccaaattgctattcaggatcataccaatttataatcccaaaataatatgaaaattcctgttttatagcactcatatttacaataaattttaaaaatcactgttaacctaatagtccttcaaaagaaaaaaaaattgaaattacattattttaatgactctattagtgagggtcattcttcccatgtttcttgttagccatgaccctataagaaataaactgcactgcaaaatgataaacatgatatcaatcattacatgggaaggcactatataaagaataataccttaggttaaggccacataaatatttatcaggtgccttttctgcggaggactctgaagggatactaaactgcatttagctgcatgcaactgaaactacttttacctacattgtctcttataaacattataactactctttgagaaagtgtttactatggactgaattgtctccccatccccccaaattcatatattgaagccataaaccccaatatgactctattcctagacaggacttataagaggtaattaaggttaaatgaggtcattaggatgggttcctaactggataggattggtggccttataagaagaggaagattctgcacttggtcttccaaattaaataatttatttaaa

SEQ ID NO: 207 - DNA, 1309 bp, Homo sapiens
tgatatctgtcatattccccacacccccattaaatccaagactgggggcacggggagacaacagcttttagacatatcttttccaacagtcgtcactgctggacactgtttcatcttgcaaataaaccaatgaaaatgagtgatcctagaagaagataaatggaggtattttgaacaatcaaagaaggacaaatgaacacctggctgagaaaaattagctcttttttctatgcataaaactattaaaatattcttcatagaaatttatgacacaggaaacataaagacaaaattaaaataactcctagtatctcctattctttttatatgtatattatatatactcatattcatatatacatatatctcacatcatgtatcatatataaaataaatttaggtgtcatgatatatatttagataaatatacttagaaacttttttatggatgtataatttatggatatattgataattatgtatttgttattgactacttcaattgattcccatttttatgcattatattatagattatatagctcacacatctttgtacataaatctttgttcaaatattatttcctaaggatagacttcatgaagtggaaatactaaatcaaaagtgaaaaacattttctaaggttcttaacatatacattgccaaattgctattcaggatcataccaatttataatcccaaaataatatgaaaattcctgttttatagcactcatatttacaataaattttaaaaatcactgttaacctaatagtccttcaaaagaaaaaaaaattgaaattacattattttaatgactctattagtgagggtcattcttcccatgtttcttgttagccatgaccctataagaaataaactgcactgcaaaatgataaacatgatatcaatcattacatgggaaggcactatataaagaataataccttaggttaaggccacataaatatttatcaggtgccttttctgcggaggactctgaagggatactaaactgcatttagctgcatgcaactgaaactacttttacctacattgtctcttataaacattataactactctttgagaaagtgtttactatggactgaattgtctccccatccccccaaattcatatattgaagccataaaccccaatatgactctattcctagacaggacttataagaggtaattaaggttaaatgaggtcattaggatgggttcctaactggataggattggtggccttataagaagaggaagattctgcacttggtcttccaaattaaataatttatttaaa

SEQ ID NO: 208 - DNA, 778 bp, Homo sapiens
agcggatggctctgcccacggatgacaactgtgcagtttgtcttccaattaactaagaggtactctccatccctcattagcataaaagccctataagtagcagaaatccgctctttactttcgacacatttctggtgttttaagatgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacaggtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaaggggagacaacagcttttagacatatcttttccaacagtcgtcactgctggacactgtttcatcttgcaaataaaccaatgaaaatgagtgatcctagaagaagataaatggaggtattttgaacaatcaaagaaggacaaatgaacacctggctgagaaaaattagctcttttttctatgcataaaactattaaaatattcttcatagaaatttatgacacaggaaacataaagacaaaatta

SEQ ID NO: 209 - DNA, 970 bp, Homo sapiens
agcggatggctctgcccacggatgacaactgtgcagtttgtcttccaattaactaagaggtactctccatccctcattagcataaaagccctataagtagcagaaatccgctctttactttcgacacatttctggtgttttaagatgcctgagccagccaagtctgctcccgccccgaagaagggctccaagaaggcagtgaccaaagcgcagaagaaagatggcaagaagcgcaagcgcagccgcaaggagagttactctgtgtacgtgtacaaggtgctgaaacaggtccatcccgacactggcatctcttccaaggccatgggcatcatgaattctttcgttaacgacatatttgagcgcatcgcgggcgaggcttcccgcctggcgcattacaacaagcgctcgaccatcacctccagggagatccagacggccgtgcgcctgctgcttcccggagagctggccaagcacgccgtgtcggagggcaccaaggccgtcaccaagtacaccagctccaagtaaacattccaagggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggcccccagccctgaaagaaaaagaagagccacactacattgaaatctggaaaaaacatctggaagcatacagtggatgtaccctggagcttagaagaatccttggaggcttcaacctctcaatgatgaa

SEQ ID NO: 210 - DNA, 377 bp, Homo sapiens
gttttcgtggcgcacaccttcgtagtatactgaagggtgtgtctcctgggtttccaactgccccggtaatagtcttttaacctaatatgcgtcagttttgataacaacactaaggcagtacagaactaaagatggggagacaacagcttttagacatatcttttccaacagtcgtcactgctggacactgtttcatcttgcaaataaaccaatgaaaatgagtgatcctagaagaagataaatggaggtattttgaacaatcaaagaaggacaaatgaacacctggctgagaaaaattagctcttttttctatgcataaaactattaaaatattcttcatagaaatttatgacacaggaaacataaagacaaaatta

SEQ ID NO: 211 - DNA, 1518 bp, Homo sapiens
atcatccggcgcggtgtttagactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatggattcacaatttgattccacaactggatttctaggtaaaactatgggcaaactgaagattttatccagagggagccaaacaaagctgctgtgctatatgatgctgttttctttatttgtcttttttatcatttattggattattaaactgaggtgatgcatgtaattgtgaatttggaatttgttccaacttaatggcttgcagtaccactttgataaaaatcagcatcaaaacattcctagtgttcaaatactgtggcattttccattgaaaattgctgaattttgcttattttataaatcacattagttaatacagtggtctttgaatactgtttcttaatgactcattttagcccctattttcaggggtagtgagagggtgtggctccactaatttccagtttgtttttctattgtttgccaactgtcagattaaatagcattataatattttgttgtaatcataaatgcaggtttatgtcccatgtaaggaaacttagtgggagagtaacagaatgcctggagagcctgactctgagctcttgaagtagtcagccagtttgtggtaaaatggtaattgaattttcctaactgcatcaactgtaatgatatactcccttctcctcctttatttagttaaaattgtaggctgatttctttttacctacaatcttcctaataatttttgatgataatgacccctcatttctttctgcccaaagacctcattctttaaataaaacttgttattttggcatatttctggtagggcccattgcacatgtgtatcagtatagttattatttcatattaactttatgaattctcttgacttggcttataatagttttatgatttttactacataggtagcacatttatcatttgtgacagaataatgtgaagttaagtaattactgaactttaaatggaaatagtatgcaagaaactcaggcattgaacttgaagataagagtattattgctttaatccagtgtatttgtttatggaaagaaaaacacaaaggcagactgttgagtaaaaaatattaaatattgttaaatattctgtattttggaatttatccatttataggcttcaaaagtaaatttttaaataaaatatattagtcgactgtaaaaaaaaaaaa

SEQ ID NO: 212 - DNA, 791 bp, Homo sapiens
atcatccggcgcggtgtttagactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatggattcacaatttgattccacaactggatttctaggtaaaactatgggcaaactgaagattttatccagagggagccaaacaaagctgctgtgctatatgatgctgttttctttatttgtcttttttatcatttattggattattaaactgaggtgatgcatgtaattgtgaatttggaatttgttccaacttaatggcttgcagtaccactttgataaaaatcagcatcaaaacattcctagtgttcaaatactgtggcattttccattgaaaattgctgaattttgcttattttataaatcacattagttaatacagtggtctttgaatactgtttcttaatgactcattttagcccctattttcagggtaatgcaataattgccctattaatatttgtgggaataattaaaggcggttattgt

SEQ ID NO: 213 - DNA, 1077 bp, Homo sapiens
atcatccggcgcggtgtttagactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatggattcacaatttgattccacaactggatttctaggtttatgtcccatgtaaggaaacttagtgggagagtaacagaatgcctggagagcctgactctgagctcttgaagtagtcagccagtttgtggtaaaatggtaattgaattttcctaactgcatcaactgtaatgatatactcccttctcctcctttatttagttaaaattgtaggctgatttctttttacctacaatcttcctaataatttttgatgataatgacccctcatttctttctgcccaaagacctcattctttaaataaaacttgttattttggcatatttctggtagggcccattgcacatgtgtatcagtatagttattatttcatattaactttatgaattctcttgacttggcttataatagttttatgatttttactacataggtagcacatttatcatttgtgacagaataatgtgaagttaagtaattactgaactttaaatggaaatagtatgcaagaaactcaggcattgaacttgaagataagagtattattgctttaatccagtgtatttgtttatggaaagaaaaacacaaaggcagactgttgagtaaaaaatattaaatattgttaaatattctgtattttggaatttatccatttataggcttcaaaagtaaatttttaaataaaatatattagtcgactgtaaaaaaaaaaaa

SEQ ID NO: 214 - DNA, 982 bp, Homo sapiens
atcatccggcgcggtgtttagactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtaagaagagggctgaggttcgaagttcggggccctagaaccgggagcgctggggcgcgggaggaaatcgaacctgtcttatgttcctggcatttggtccaaaaaacaggatgtctagaggggatctttggggtccatgtcgagtggaaacacaccatttgtcccagatctttggaatttccttaagtttgagtcagattcaagtttggatggtaggctagagaaagtagtggactaggggtgggtgtgtacaggtggcatctcagtggtcgagtgttttagtgttattgactgagcgtggttatggacgctgctatgttttccaaagcccgactccggtttctgtttccctactggccctggatcttagtttcttcagaagcggaatttgaagagtgggtggttgcacccaaagcacgctagtaatggtcgttaatctggtaacagtgagttacaaaggtaaatgtatgtgtcattattgttaaaggtcctggaactggaacttctgggtcaaaggcgatttcttaatctgaaccttgtgccacggttaaggcagtagaacgtggttaaggtttggcgacttaacatttgatctttacctttggggttaggaaactggctcatcagcaagaataagttagacacaaggaattttaatggacccttatagtaacgcacagctactagaacggcattttctggttctgaagctttctcttaggacacgattttttttttttaaagaagaccccgctaaattagagtgcagtatacttcagaaaataaatgaaacatttg

SEQ ID NO: 215 - DNA, 867 bp, Homo sapiens
ttttacattctcagtagaatctgagaaatggtcctgacaactcagattccaacccaaatcaagcaaagttaatatttgtattgttggaacttgattcaaacaaataagcaaatcttgactctatttcaaaaatctctttaattctttatattttgggttatgaatgtattttcttggattttactgagttttcaattctttttgttcatccctaataacctgtcagtttgggttctattttttctggcttcattcgtcattatttgggcctctacctgacaggttaaaaccaccggaactgagtgtggttaagggacttaaacagataagcctgacgtgtgatgggagaggcactggtttgagttagatgacctgggttcatatctctattccttaacttgctcactgcttttgtccttgatttcttcattacaccatctatttcataggatagttgtgagaagtagataatatgttgtaaagtgcctggtatgcgataatcactcaataaatgttggttctcactaccattaacagaaattctcagaaaaggtagttattttaaggacaagacaataggttgttttcaggcttcaaggtgatgaaatacctccaagtaggtattttcatcaggcaattggagagtgactcattcattcaagaagtttttaactgtactttgtgtcaagtatgtgacaccagagctcacgggagattcagaaatcattgtcaataattaaagttgtgaaaaacgggaagagcagaaggccaaagaaaatgacttaaaaatgaaaacaggagaatcaacaatggaagtagaggatatcaaagccttaggaaaaccaatgatggcaagagaaggatgga

SEQ ID NO: 216 - DNA, 1464 bp, Homo sapiens
atcatccggcgcggtgtttagactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatggattcacaatttgattccacaactggatttctaggtaaaactatgggcaaactgaagattttatccagagggagccaaacaaagctgctgtgctatatgatgctgttttctttatttgtcttttttatcatttattggattattaaactgaggtgatgcatgtaattgtgaatttggaatttgttccaacttaatggcttgcagtaccactttgataaaaatcagcatcaaaacattcctagtgttcaaatactgtggcattttccattgttgaatactgtttcttaatgactcattttagcccctattttcaggggtagtgagagggtgtggctccactaatttccagtttgtttttctattgtttgccaactgtcagattaaatagcattataatattttgttgtaatcataaatgcaggtttatgtcccatgtaaggaaacttagtgggagagtaacagaatgcctggagagcctgactctgagctcttgaagtagtcagccagtttgtggtaaaatggtaattgaattttcctaactgcatcaactgtaatgatatactcccttctcctcctttatttagttaaaattgtaggctgatttctttttacctacaatcttcctaataatttttgatgataatgacccctcatttctttctgcccaaagacctcattctttaaataaaacttgttattttggcatatttctggtagggcccattgcacatgtgtatcagtatagttattatttcatattaactttatgaattctcttgacttggcttataatagttttatgatttttactacataggtagcacatttatcatttgtgacagaataatgtgaagttaagtaattactgaactttaaatggaaatagtatgcaagaaactcaggcattgaacttgaagataagagtattattgctttaatccagtgtatttgtttatggaaagaaaaacacaaaggcagactgttgagtaaaaaatattaaatattgttaaatattctgtattttggaatttatccatttataggcttcaaaagtaaatttttaaataaaatatattagtcgactgtaaaaaaaaaaaa

SEQ ID NO: 217 - DNA, 2406 bp, Homo sapiens
ctataataagctagggacctctttaaaaatgtatatgcctgattctgtctttaaatatactgatttagaatttcgtgaggagggatctagatgtaaatattttgaaaaaagcatctctggtgattctgatgcataaccatgaaaaagcatctccggtgattctgatgcataaccatggtgaagatccatagatctaaagtatatgagccacatagacactgagctatacaaaggatatttattattatgccagggcttttacatctcaggatattataatttctatgaaagtatgtgtaatatttctagtccctacctaagcctctctcatctttaggattttccagctatgttttaatacgttagtttttccccatccatatttatagtccttatcacattttactacctctatatgatattctcttaacttaatagactctacttcaaagtcagctgtctaaacaaaaggatattaaaagtaaaggtccaaggcctagcatggtagctcacgcctatactcccaacattttgggaggatgaggtgggcggattacctgaggtcagtagttcaagaccaccctggccaacatggtgaaaccccatctctactaaaaatacaaaaaaattagctgggcgtggtggcgtgcgcctgtagtcccagctacttgggaggctgaggcaggagaatcacttgaacctgggaggcagagattgcagtgagctgagattgcaccactgcactccagcctgggcaacgagcgagactccgtctctaaataaataaataagtaaataaaagtacatttaactgctaaccgtattacattttggatgaaatcctctacttgggtagcagtcaaccatttgaccttggagagcaatggcacaacaaaaagtggggaaaaaaatctgtgtgataatgcacaaagtacttacatttattgttaattttttttatccacataattggaataacacctaaatagttttgagttgttgaattactctgtggagctgaaagaagtgtttattggacaatgaaagagctttttattcgctgagagtattactgtattttgcatggagaaatcaggctgattatccaaggttatcaacaggctcctgaattgattaaacacaagactgtcattacaaatgtactatggtaacagttattcaatgtacttggatatgcatatgtagactcttagaatctaactgtgatattttatttgcctttatctctgataggattcacaatttgattccacaactggatttctaggtaaaactatgggcaaactgaagattttatccagagggagccaaacaaagctgctgtgctatatgatgctgttttctttatttgtcttttttatcatttattggattattaaactgaggtgatgcatgtaattgtgaatttggaatttgttccaacttaatggcttgcagtaccactttgataaaaatcagcatcaaaacattcctagtgttcaaatactgtggcattttccattgaaaattgctgaattttgcttattttataaatcacattagttaatacagtggtctttgaatactgtttcttaatgactcattttagcccctattttcaggggtagtgagagggtgtggctccactaatttccagtttgtttttctattgtttgccaactgtcagattaaatagcattataatattttgttgtaatcataaatgcaggtttatgtcccatgtaaggaaacttagtgggagagtaacagaatgcctggagagcctgactctgagctcttgaagtagtcagccagtttgtggtaaaatggtaattgaattttcctaactgcatcaactgtaatgatatactcccttctcctcctttatttagttaaaattgtaggctgatttctttttacctacaatcttcctaataatttttgatgataatgacccctcatttctttctgcccaaagacctcattctttaaataaaacttgttattttggcatatttctggtagggcccattgcacatgtgtatcagtatagttattatttcatattaactttatgaattctcttgacttggcttataatagttttatgatttttactacataggtagcacatttatcatttgtgacagaataatgtgaagttaagtaattactgaactttaaatggaaatagtatgcaagaaactcaggcattgaacttgaagataagagtattattgctttaatccagtgtatttgtttatggaaagaaaaacacaaaggcagactgttgagtaaaaaatattaaatattgttaaatattctgtattttggaatttatccatttataggcttcaaaagtaaatttttaaataaaatatattagtcgactgtaaaaaaaaaaaa

SEQ ID NO: 218 - DNA, 1255 bp, Homo sapiens
  misc_feature (33)..(33): n is a, c, g, or t
  misc_feature (38)..(39): n is a, c, g, or t
cgtagacgtgtattccccactattattggaatncaggnnagggcttactgtaacttgaataggcctttgagttaaaacccagaataaattattagctgaaatggattcacaatttgattccacaactggatttctaggtaaaactatgggcaaactgaagattttatccagagggagccaaacaaagctgctgtgctatatgatgctgttttctttatttgtcttttttatcatttattggattattaaactgaggtgatgcatgtaattgtgaatttggaatttgttccaacttaatggcttgcagtaccactttgataaaaatcagcatcaaaacattcctagtgttcaaatactgtggcattttccattgaaaattgctgaattttgcttattttataaatcacattagttaatacagtggtctttgaatactgtttcttaatgactcattttagcccctattttcaggggtagtgagagggtgtggctccactaatttccagtttgtttttctattgtttgccaactgtcagattaaatagcattataatattttgttgtaatcataaatgcaggtttatgtcccatgtaaggaaacttagtgggagagtaacagaatgcctggagagcctgactctgagctcttgaagtagtcagccagtttgtggtaaaatggtaattgaattttcctaactgcatcaactgtaatgatatactcccttctcctcctttatttagttaaaattgtaggctgatttctttttacctacaatcttcctaataatttttgatgataatgacccctcatttctttctgcccaaagacctcattctttaaataaaacttgttattttggcatatttctggtagggcccattgcacatgtgtatcagtatagttattatttcatattaactttatgaattctcttgacttggcttataatagttttatgatttttactacataggtagcacatttatcatttgtgacagaataatgtgaagttaagtaattactgaactttaaatggaaatagtatgcaagaaactcaggcattgaacttgaagataagagtattattgctttaatccagtgtatttgtttatggaaagaaaaacacaaaggcagactgttgagtaaaaaatattaaatattgttaaatattctgtattttggaatttatccatttataggcttcaaaagtaaatttttaaataaaatatattagtcgactgtaaaaaaaaaaaa

SEQ ID NO: 219 - DNA, 1221 bp, Homo sapiens
  misc_feature (939)..(940): n is a, c, g, or t
  misc_feature (944)..(944): n is a, c, g, or t
atcatccggcgcggtgtttagactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatgtggatccttcaggttccagggatttcaccagtagcagtgaaagcctacttctgctaattttgactgttcctcagcatttgtccagaagcttaaaaagaaggaggcttactttcagtgccatctatcacagctgcagaattatatcatgacatgtcaaaataatgactctgaagccttccaaatcttccaagaaagaagaatccttattttagattagtaggaaatggctttctaccactctgaaaagtctcttcttggccaaacatcaaagtctggagccagagatgtaagcagaaatggggcggaaagagctcacatgttgaatcaatcagccttgatttgaatcaaccttccatcaattaccagctaagtaactttaaaaaagtcacttaatctctctggctttctatttgtccctatgtaacaacctgtgatggtcatgtgtggtctgtcctgatggggaaatgtggcgcttgtaggcgagaatagcgtgggtagtatacatcatgggcctggtactgaagacgcggtccgggtcgcccctagctgtttcctactcacccaaagcccgcnnccgncttttctctctctcctctggcaggatgaggcgtgcaggcctgggtgaaggagtacctcctcgcaactatgggactatggctatgctaatagtgggtatagtgcctgtgagaagaaatgagaggctcactgaaagtctgagaagcaaagtaactgctataaatctctttccattgaataggccatgaggttaaaccaccggactgagtgtggttagggacttaacagatagcctgacgtgtgatgggagaggcactggtttgagttagatgacctcgg

SEQ ID NO: 220 - DNA, 844 bp, Homo sapiens
atcatccggcgcggtgtttagactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaaaatgagaggctcactgaaagtctgagaagcaaagtaactgctataaaatctctttccattgaaataggccatgaagttaaaacccagaataaattattagctgaaatgtggatccttcaggttccagggatttcaccagtagcagtgaaagcctacttctgctaattttgactgttcctcagcatttgtccagaagcttaaaaagaaggaggcttactttcagtgccatctatcacagctgcagaattatatcatgacatgtcaaaataatgactctgaagccttccaaatcttccaagaaagaagaatccttattttagattagtaggaaatggctttctaccactctgaaaagtctcttcttggccaaacatcaaagtctggagccagagatgtaagcagaaatggggcggaaagagctcacatgttgaatcaatcagccttgatttgaatcaaccttccatcaattaccagctaagtaactttaaaaaagtcacttaatctctctggctttctatttccccatctggaaagtaacacatacctcacaggttgttattaggaacaaataaaaaatttgtgtcaa

SEQ ID NO: 221 - DNA, 400 bp, Homo sapiens
agaggacagaggaacatgctgcaccatgtgtatgcagtcaacaagttcagttcaaatatatcttggatccttcagcaaataatgtataaggaacataaaaggtagagagaaaaatctatggataaaaagagacttaaaagaaatgtcaaagtttaaaaataatacaatcctaattatatttggtaaacatggatgttagagctgtttttaaaagctggaatgtcattactataaaagtcaggagtgattacctgtgtgggaagggaaggggctgtgatgggactgatgccttggtggttttagatggttggtaaagttttatttcttaacctggtagtggttctgaggctttttgacttagtataactcattaaaccacacatttattttgcatgatttt

SEQ ID NO: 222 - DNA, 622 bp, Homo sapiens
aaaattagccaggcgtggtggtgggcgcctgtaatcccagctactctggagggtgaggcaggagaattgcttgaatctgggaggcggagtttgcagtgagctgagtcctcgccattgcattccagcttgggcaacagagtgagattacatctcaaaaaaaaaaaaaaaaaaaaaagaatcccagaaattaaatgttttatatttttgccacaagaaaacacgtgcaagtatgaaactttttgtaaggtcctctgagctggctgcactatggtcaagccacggtgacattcccccacccttgtgataatgtactttgtgatactcctgtccttgtgaatgtactttgtaacattcctccccacccttgtgacaatacatcctccctgcccttgtgacgatacaccctccctgcccttgtgaatgtactttgtaacatcctccccacccttgagaatgtactttgtaatatccatcccctgcctgtaaaaaattgctcctgactacaccgcctatcccaaacctataagaaccaatgataatcccaccaccttttgctgacccctttctcggactcagcccactcacacacaagtgaataaacagccatgttgctcacactaag

SEQ ID NO: 223 - DNA, 650 bp, Homo sapiens
aaatattaagtgaaaaagtagtgacttaattgtgtagaactaaaagacagtaactgcaagttaaatagacaagggagttaatccagtctttgcctatgtatgaccgtgggtaagttaatcttactatacttcagcttcatcatttataaaatgagaaattaatagtactaatcacagagattgataaaagaattaattgacgtgagatatttagcacgctgcctggagtttagaaagcatccaataaatgttatcttttccatgagttaggattttttttattataatagaaaacccaattcaaacttgcctacagagtaaaaagaaatgacttttgtcacagctgaaaagtctagcagtagaatgaactttaggtattgtttgatcagggtaccatgctttcagacctggtcttgctgatgtgttggctttatcttcagctggtttcttccctcacaatagcagataatcacagcagtttcaggccttatatccacacatccagaaagaaagaatttctcatatcctccaactatcaaaaaaaaaaaaaaaaaagtcccagtttacatgctggaactccaatttagggtctgtacccactcctgatgccatgcactgattggcacagagtatgggatgacaatttatgc

SEQ ID NO: 224 - DNA, 329 bp, Homo sapiens
catccttacatggcagtcacctagcaaaagccccactttctgtcaccatcacattgggtgtcaggatttaccatatgcattttggaggtatacaaacatttagtctatagcaatatcctttatcagatttaaagacatcttcaattcatagtttattatgaattcttatgaatgaatttgaattgtagccaatgctttttctgcatcaattaaggtgattatttgatgtttttaattcacgagatgaattagatagattttcaaattttcaaccatccttgcatttctgagataagtcaagtttgtcataatatattatctttactaaa

SEQ ID NO: 225 - DNA, 418 bp, Homo sapiens
ttcaagcgaagttcttaggggtagaatatgagcggcacaagcgcgaagctcgggcctgctgtgtacccacgcgtgcacgcaggtgtaccagtgcggacaagagctggggcagccatccacttcctgaacacggcgggagagagatgctaaggggaaggagggagcctttttggttttctctcccgcgtccgcctatgtcctggcagggggtcttggggaaatgggagggtgaaccccagcacacccacccggacggtggtgacatcatagctttccgtccccatggcaacgggcagccgggtctccggttgcattgacttaaccgccggcctagactagcagagaagcgtggactgagttcctccagccaagcactgggtggaaagttttgggggagctgcgtcctctggtggatgct

SEQ ID NO: 226 - DNA, 385 bp, Homo sapiens
tttaacatttatttacagactggaatattaagctttatgcaaacctaagaggccatcataaaaataaaaatacatcatgtatatttattttccctaaatattctaaccaacacgcaaaataattttccaagtcttagactagtaattgctcaacttgaatatgttgtttgagcaccatttggtacagtggctactgaaaagcactgagtgtttcctttcatactccatttattcccccgccttttggaagtgttcagacatttttacagttcgtgtttgtctagccaaaatatttcactggaagcccatgggggtctttctactcctcagaaagcgagcagagtgtgagtgtttgactcccagggcaccatactataatagctat

SEQ ID NO: 227 - DNA, 606 bp, Homo sapiens
cagtattcaacattaagtatatacttaagcagtaatgactctgaagctatgctttgcattcatgaacacactccatagggttacgcttcaagcactaggtgaagccaagattttctgaattatgtttcattggggaatttttacctttttttcctgtttatgacagtcatttcatctggttttataatgaggtcaggaacaggtgaatgtaaaataatactagtaagctgagtgatttctgtgttaatgattaggctattttttaaattaaaaagttctggtatttgaaacatgctcagtactttaagtacacttactagtaattaatcagaatgaaagattttaatgttctctgattatgtacaaatcattatggctacctgtctgcaagaagtcaggagaaactggtatctcggctaaaactgggggaaaaactggtgtcgtctttgcttatttttcccattctcccagtaaatacaaagcattagcatttgtataatataggggtgtacttaactctttccccttaaaaggccaactttccccctttataaaatacaggtctgctcattaaaccaataacctttaaaaaatgagacatcaaaa

SEQ ID NO: 228 - DNA, 408 bp, Homo sapiens
tcaaaaaaaaaaaaaaatttatacctatgtccccttaacttacacatacccatcccaattctgccctgttaatttatatgtgcacttccttattcattcttctttagtctttctctttataccttataatctaggatagcacagagacaaaactaatgacccaggccacaagaggggattttttttttagcaagacgaatgctttccattaaaaaaaatcaatgctttttttttggcaaaaggaatgctaatttgcaaggcacccctgaagcctgtttttaggcttggcttttggaaaaaccatttgagcctacaacacactcttagacgctccccaaacaggagacgataattaccacagaagccacattcactccacgtattcctgctgttggataaatgtatttt

SEQ ID NO: 229 - DNA, 389 bp, Homo sapiens
agtgatctgtgactgcttttgtgctacagcagcaaagttgagtagttaggacagagatacggcccacaaagtaaaaatatctactctctagccctttatagaaagtttgccaatctttgatctaatgcttagcctagaattctgcatatactggaataatacttattgaattaataaattcacttacgaatgtattatatacatttaaaaccttatatcaaattattataggtttatttacttcaattaacctaaaccaaggtaatatataagaactaagggctgggcgcagtgattcacgcctataatcctataatctcagcctcccaaagtgcctataatcctagcactttgggaggctgagatgggaggatcacttgaggccagaa

SEQ ID NO: 230 - DNA, 560 bp, Homo sapiens
agttacaatttcatactgccccccttctcctgctctagcgagaaaagaatcagactcacagcttgacccaggccaacacaggaatagttcaagctcctggcccacactgcacctgggggagcctgaagcttgtcctaccgtgggagcaggagccttgagtaccaggaatttcaatgggatgtttttgagtttaggaagttaggctggctgcattccatgacatgcaagggagaggattttggagtagcacagaaaatggaaaccttggccgggcgtggtggctcacgcctgtaatccgagcacttcgggaggctgaggcggggcggatcacctgaggtcaggagttcgagaccagcctgaccaacatggagaaaccctgtctctactgaaaatacaaaatattagccggtgtggtggtgcatgcttataatcccagctactcaggaggctgaggcaagaaaatcacttgaacccgggaggtaagaggttgtggtgagccgagattccaccattgtactgcagcctgggcaacaagaatgaaacttcgtctcaaaaaaaaa

SEQ ID NO: 231 - DNA, 466 bp, Homo sapiens
agtggaactcagtgacaatcgaacattccactgagacctaatatccttcagatgagtctggcatctggaaggcagcatgctgtggaatctggcttgttggaagacagaactgtgttctgctgtggccgttgcaattactatttccagaataattgtgcaagtgcctcgcctctctcagcttcaattgcctaatctgaatgttgagcaagtgcctgacccttcctgagcaacagttccttcatctgtaacatgggggtactttaatcaatctcatcattgtgaggattaagtgtgaaaacaaaaggtacttcaagtgatcagtaaataatggatcctcggtaagtggtagctctcttctttctttcccttaagtttcagcccaacagatctctttcgtcagctgttatcattgtaaaaatcatcagttaaaggcaaataaactggcctccaattatgaggatttatt

SEQ ID NO: 232 - DNA, 381 bp, Homo sapiens
ttcaagtcattaaggtccttcatgtgccagctagtcagagacccagagcccgtgagtccccctcccagatcagcgcacccaggccgcatctgagcgactgcgctggtgcacatgtggctcaaatctccagtctgctcatggttttgaatgtcccaacaactgcaggctttggccaaggccaccctctcatctcgctgtgtggtaagggcttacatatccagacgtgcatgtatgcactgttgtctagatttttgtttttaaaaataatcgtggacctaaaaatagtttcttcctaaaattaattccctaaaatacactgactagaagccccacactctgaactgatgctttagtgaacctctttgcttaatttttgaagat

SEQ ID NO: 233 - DNA, 323 bp, Homo sapiens
taaagcctgctggtcagagctctgatattaggcttggggagacctgggcttgaatctgggcccatcactgacttgctgtgtggccttggaggagtcactacacctctctgagttgtgctgtcctcttttgcaaaatgagaatacctcctaccttgcagggttgctgatgggagaccagagagagtttgttaagaggctatgattgtgcctggtaagaaagagcctctggctgcagagatggcattcactgttgaacatcaagcatcttaggactctggccaaccaggctgttcaggaaatgtcctgtttctttaaaaaaaaaa

SEQ ID NO: 234 - DNA, 328 bp, Homo sapiens
aacagtgtcaaacagagacggaggctctcggaagtcacagcgtttgcagcaaggtggctcccagagctgggaggaaagccccgcctgcagccaagctcctgctccaccaccccaggtgcagaggggctgccccaggcgggggactccaactccctctcagccagggccaggcctgtggggtccgggccttctcagggccgaggcctcactgcccgagcacgggccctgcctgcggcagttacgcggatggttcctttttaaacgcaggagctgccgtcatcttctctcactcaacggtcatcatggaaagtgaaaacgacggtgcggc

SEQ ID NO: 235 - DNA, 407 bp, Homo sapiens
gtccttctttaaatttgtaatacgtctttttccaagatattgtttgattctaaacccatacactgatatcaaaattaattacttaacaaaatcccaagaatgaatcttacatccttaaggagaagaacattaatctgactcagactgactgaatttaaaatttatttgcagttaacataaaacattcagttttaagatcattgttacattttcaaacaggcaaatcttgaaagacttgcctagatttgctctcagcataatttatatatttttttctctaagaaatagtttagcttccacttaaaatgcatgatgtacatatctgccatattttgttttattttagagatctaaattctacattaagtagaatatgcagttttagattaaaaaaacagaaaaccttt

SEQ ID NO: 236 - DNA, 313 bp, Homo sapiens
acatgtttttataccctatactctatctaaactgcagagcaacttctgtagcaggaagcactcttggagtctatgtggtggatctataccaagggatatatcgttcgcttgtaatgagttcttggggtgtttggctcttatttcttttctcctactgagaagtttgataaaccaagttattgatcatagaagcagtcatccaagatacggctgaaagtaaagccttgggagccagatggcttcccgctgatttttatatgcagtttatattctccttggctgtgtcttcctggatgtttcaatgaaagatatt

SEQ ID NO: 237 - DNA, 383 bp, Homo sapiens
ttcctatgtaatgcatcaggtgcacaagtctagacacatttagattagaaacagcccagaatgcatattagacgcatatttatcatcttgatttattaaggagcagctgcagaatgatactaattaagtgtctgtgctttctttttgagactataattgtttttttagaacaagcaaaatgtaaggaaacaaatgggcaagggtatttgaatgcattaaatctctattatatagacaatgtttctttacatttttctgcaacttacacattaaaggaggacattcccgtggtttacaaaaagttgtctatagtaaacattcctctgagactttttttgtggtgttatttataccattttgagtcatttagcctatagttctgg

SEQ ID NO: 238 - DNA, 417 bp, Homo sapiens
atattacgccatattataatttgaaaaacagtttcagtagtgtggttctgatgcatgattacacagacattccatggaacagaacagaaaaatccagaaatagcctcaaacacgtgaacatttactatataaagtggcatcaaaggtgggtggggggaaagatggactggtgttgagacaacagggaaacaaattagatatcatgcactgtagtagaataggctccaaataatgaagagatttcaatgtaaaagaaaaaaaaactcatcaaagtatttgaagaaaatcacgaggaaattcaaatactggagtggggaaagactttctaattaagactaaaaatctaaagcctcaaaggaaaggctagtaatttcaaatgcataaatatttttaaaacctccattatggcaaaaaaaa

SEQ ID NO: 239 - DNA, 216 bp, Homo sapiens
ctgtgtgcaatgggacccagcggggcctttgaggccacattctggctcctccgccatcatcgtgtgattttagacaagaaatttaccctctctgagccacggttttttcagcttgcaatggggatgatcactccttcttcccagggctttgcagagggtttgctgagccaccgtggtgaggagctgacagtgtgcccagcacgtagtgggtggccc

SEQ ID NO: 240 - DNA, 883 bp, Homo sapiens
gcagttgtggtagatccacaaaacgtataaagaaaaatacacgtttcctgaaacaaaacacttggaaaaataagctgctaagaactggcgaattagaagtttgcagacagggaactgaagtgtcatctcttggttcaccctggagactgatgtgagtggatctgatgcaatgctgctggaagatttacctgcacaggttgctcctctaaggcaacgcgcagtgcacgattgacgtatgcaccagagctaggctgggcctcagctcgctccatcttttgccctttttgatctctttagatagataaaataccaagttctcagagtgctaaacaacaaattatatatacctaaaggtgagatgatcaggtttaaacttcctgtaaaagaggcgagaaggcgccttgcacacccttttccagatagggctggcagcatgttattcagaactgaatcagtctctgccagagaattcccagtgggaacctggagcaggtatgttgatgaaggggatacctggggacctttggtcactcacaatgagttttggtttgtattctcactgttgttagcattgccaatgaacaattgcacctacaatttgattttagttttagatagaggcgaatccactgattaaaaactcccattaaaataaagaatggaattattgtgaaacctgcaagggtgccttcaaaaagaaaaccagtgctgttgtatacctacctcgcctttctatttgctttttgaactttctaaaaaacacaaggaagctttttgctaagcatcagggcatttaaatttatattcatcagttgttcattttcttaatatgtaatgatgcataaaaaggctgcaaggaaatcacatctgttaatttttaggg

SEQ ID NO: 241 - DNA, 415 bp, Homo sapiens
aaaatccagtacccttttagacctttggctcccaaggggcatcccatccccctgataatgaagtatggattattgcaatcctatcagtccccaacataacacccccatttttcctgttaataagccaaacggggaatatagatttgttcaggatcttagggcagttaatgaggcattagttccagtcacccaatagttcctaatctttataaaataataactcaagtccctgaagatgcttattggttcatagtattaaatttaaaagatgttttctttcacacacctttacacctggacacccaatacatttttgcatttgaatggactaatccagacactcatgctgcatctcagcttacctggactgtcctgtccccaaggttttcggacaatccccatctgtttggcaatg

SEQ ID NO: 242 - DNA, 888 bp, Homo sapiens
ctgaggaaggaggacaaagaaagcactgaagaagtgataaaggggaatgaaatgagatgttatcagaaattgctttctctttggctacggttaggagatcccatgttttacctgggccttttaatgatgacgattattatttggctctcttttgatttcaagataatctcttttaagagataacttttgatatagtttttaaataattttctgtttttcaatacttaatcttaaaaatggagttttctgccgtacgtatctcacataattattgtgaggagtaagtgggatagcaaatgccaaaattgcgcaattttacatttagaagacagcacaaccgtccatcttccagatctgctcacagctggtcgggggcctagtgaagcattgaaactggctctcctcagtctagccattgctttttgtttaaattatagtaaaatttagatttaaatttgtaataaaaaatttcaatgtttatcatttaagtgtacaattcagtgacattaagtacattcatgttgtcttgcaactattaaccactgtccacatccagaacattttgctatcccaaacagaaactctacccactaaacactaatcacacccagctctattttctgtctctgtgattttgcctatgccaggtccctcagtcactgctttttaattttcatccctatattgccccataaagtttcaaagcattggatacattaacatatgtatgacatttgaacattttaaaggtatttccaaagacagaatataaaatattattaaataaagagtgtaactgtggcagagtctggactttggtgacagatcgctggattctaatagcggttctatgctttattgtatgatggctagtcaggtcacctctca

SEQ ID NO: 243 - DNA, 381 bp, Homo sapiens
gagacagagtctcactctgtcaccaggctggagtgcagtggtgcgatctcagctcactgcaacctccgcctcccgggttcaagcgatcctcctgcctcagcctcccgagtagctgggactacaggcatgcaccaccacacccagctaatttttgtatttttaatagagatggggtttctccatgttggccaggatggtctcaatctcttgacctcatgatctgcctgcctcagactcccaaagtgctgggattacaggcatgagccaccacacctggccgatcccagcatttcctactcctctcaggaacagcttaggacagaatcacttcattatgatagagctgtacttttctgtaaaaagaatccagctacaatgtgt

SEQ ID NO: 244 - DNA, 2338 bp, Homo sapiens
tatgaactttacttgagacagaatatggttaaaattaggaacatctactttgaatgaggtttatttttctattttgaatttgccttatgtatattcaaaggcttatggaaatactgtaaaggaacattaggaaaaggacaaataggctataaccatctatcttaaaatcagacccttagtataagcacctctttttcttttcctctttgacaatttagtctcttatttaggtccatgtaattaatttcattccattattttttagctgtttattctaaaaaacaaaaattttcagccactcccatttattctcccatgacatggtcctatatagcagtacttaacacagtgccttgcacatagtaggcattcagtaaatacttacatgcatgaatgaataatgtattttcagtgtaacaaatttattataaaagtgtagttcgactcttcttggtcttggagtttgagagtacagaattacagggaatgaagagaggtataagtagatattttaatggaaatgaagtataaattaataacttgacttacccctccataagttactgctaactggagatacccttgtatgcccaacctgtaaaggaaaaagttctatttctatatttataggacattcttctcagtcaaggaacagtaagaaatatgtaggtttcaatcagttgctctcaaccctgactgcattttagaatcatttggagagtttttaaaaatatccatgcctgaatcttgattcccattttcatgtaatttgagacaagacctggtcatcagtattttttttaaagttctccaggtaatttgaatgtgcaggaaggattcagaatcactggtttaatttgttattgaaaacagtaccagtattaaatgtgtttcctcttccttcttttctgtatgtatgtgtggtttttgattttttgttgttgttgttgttttgtggccaccctttgcactagaccatcccttttattggtggtattggcctatattcccattgacaaatgcaatttttaattatttatttaatataggagtattttactgtttaatatttaaacaatgtttaatgtatttcattattaactagtattatagtttgtttttttcccatgtctccataacttttactaacatttgtttttagcagcacaacagtaatccatataaaaacaactaattcataatgaggaaaatctcataatttttaaggcagaaagaagtattaatttttgatctgccatgtagaatgagacaaatacagtttgcttatgaaaggaaagtggcatacttttaaattggtctacacagaaaagtaaaagtaaactattcatttaaataagattcattatctaataaatattgagggaatatttttcctaaataaaaatttttctgactgctaacaaaaattaaagtgattacattgttcttttttggaagggtggggaggaattatttgttgaactaaagtatataaaattttttgagactagcagtatattttataatattacaaatacaacaattatttataaaagctagtcaaattaatggcttagaaagtagctgtaaactttgtgttttgaaattgcttgtttaaatgcaaaattatgagtaagataagtctttttaaattttttatttttaatttttttggaagtttattaaagcccttcatatacacatactttttaaaaaaagattcttaataaagaaattattggtttgtctggttaaagtccatatagaatgctgagaaataatttataaaataagaactatagaaatttgttctcagctgaaaagttggcagctgctctgtttctttaaaaaagtacaacatgaaaatttaattacattagccttaatattacttgactgaatttctactatttattcacttgtgtttgagattcacccagctattctaatgatagaaataaaaagtggagaaatgactaaagttgacttaagttaagaattggagtgggaattttgaaatgccatgtcctatatattctggcatatttgttggcacatttgcaagtatgttgatcccagcattgtttatatctgttggaataataactaaggaaaaattgaaaatgtataatagatgtataaagatttatatttagttagtatataatagataatacttgcaggttttttatgtgttttgggtttctgtgtattattttaggtaatctttataagggcatcttggaagttataaatatgtgccatttactgaaaagtgggaagcatttttatatgagtaaagctaatgaaataaaactagttttattgccaaaattca

SEQ ID NO: 245 - DNA, 1423 bp, Homo sapiens
tatgaactttacttgagacagaatatggttaaaattaggaacatctactttgaatgaggtttatttttctattttgaatttgccttatgtatattcaaaggcttatggaaatactgtaaaggaacattaggaaaaggacaaataggctataaccatctatcttaaaatcagacccttagtataagcacctctttttcttttcctctttgacaatttagtctcttatttaggtccatgtaattaatttcattccattattttttagctgtttattctaaaaaacaaaaattttcagccactcccatttattctcccatgacatggtcctatatagcagtacttaacacagtgccttgcacatagtaggcattcagtaaatacttacatgcatgaatgaataatgtattttcagtgtaacaaatttattataaaagtgtagttcgactcttcttggtcttggagtttgagagtacagaattacagggaatgaagagaggtataagtagatattttaatggaaatgaagtataaattaataacttgacttacccctccataagttactgctaactggagatacccttgtatgcccaacctgtaaaggaaaaagttctatttctatatttataggacattcttctcagtcaaggaacagtaagaaatatgtaggtttcaatcagttgctctcaaccctgactgcattttagaatcatttggagagtttttaaaaatatccatgcctgaatcttgattcccattttcatgtaatttgagacaagacctggtcatcagtattttttttaaagttctccaggtaatttgaatgtgcaggaaggattcagaatcactggtttaatttgttattgaaaacagtaccagtattaaatgtgtttcctcttccttcttttctgtatgtatgtgtggtttttgattttttgttgttgttgttgttttgtggccaccctttgcactagaccatcccttttattggtggtattggcctatattcccattgacaaatgcaatttttaattatttatttaatataggagtattttactgtttaatatttaaacaatgtttaatgtatttcattattaactagtattatagtttgtttttttcccatgtctccataacttttactaacatttgtttttagcagcacaacagtaatccatataaaaacaactaattcataatgaggaaaatctcataatttttaaggcagaaagaagtattaatttttgatctgccatgtagaatgagacaaatacagtttgcttatgaaaggaaagtggcatacttttaaattggtctacacagaaaagtaaaagtaaactattcatttaaataagattcattatctaataaatattgagggaatatttttcctaaataaaaatttttctgactgctaaca

SEQ ID NO: 246 - DNA, 893 bp, Homo sapiens
ttttataatattacaaatacaagaattatttgttgaactaaagtatataaaattttttgagactagcagtatattttataatattacaaatacaacaattatttataaaagctagtcaaattaatggcttagaaagtagctgtaaactttgtgttttgaaattgcttgtttaaatgcaaaattatgagtaagataagtctttttaaattttttatttttaatttttttggaagtttattaaagcccttcatatacacatactttttaaaaaaagattcttaataaagaaattattggtttgtctggttaaagtccatatagaatgctgagaaataatttataaaataagaactatagaaatttgttctcagctgaaaagttggcagctgctctgtttctttaaaaaagtacaacatgaaaatttaattacattagccttaatattacttgactgaatttctactatttattcacttgtgtttgagattcacccagctattctaatgatagaaataaaaagtggagaaatgactaaagttgacttaagttaagaattggagtgggaattttgaaatgccatgtcctatatattctggcatatttgttggcacatttgcaagtatgttgatcccagcattgtttatatctgttggaataataactaaggaaaaattgaaaatgtataatagatgtataaagatttatatttagttagtatataatagataatacttgcaggttttttatgtgttttgggtttctgtgtattattttaggtaatctttataagggcatcttggaagttataaatatgtgccatttactgaaaagtgggaagcatttttatatgagtaaagctaatgaaataaaactagttttattgccaaaattca

SEQ ID NO: 247 - DNA, 451 bp, Homo sapiens
gctgtcagtcaagcaatctattacttgtagccaaatgcatcctagcagcaactaagtatatgttttcatcaaacttcagattcctggcaacatggcagtgcagtttgaagtgtgggcattggtgtgagttcctgaggggctgcttaccagctgtgtgtgttccagggggagttatttaacatatggaagcctcagtttcatcatctaaacaattggtattacaattgttttgaatccataggtgttacagtctgaatgtgtcccccagtattcctgtgttgggaagctaatccctaattcaacagcattggtttttaaggcttttggggaggtgtttaggtcatgagggctgagcccccatgaatagattaatgccactataaaaagggagggagtgggttcactctctcttgctcttccaccttcggcatgtaaggatacaatagtaagg

SEQ ID NO: 248 - DNA, 1790 bp, Homo sapiens
  misc_feature (1046)..(1046): n is a, c, g, or t
  misc_feature (1127)..(1127): n is a, c, g, or t
  misc_feature (1156)..(1156): n is a, c, g, or t
actgcattagaaggcaagccattgggatttgcagtaaatgtattacagaacacaagtgacttgctgatactgcttgtttagcagtttgcaagggcaatggcagtatggatttttgaattagaagggaagggctgttctttctctgtgtgggaacatctagttgatggctggggagaaaattgatttagagaacaaaatgcagccaccgttatttgtgccatttgaaaggcctctatggattagtgagtgaaaataaaaaggttgctttcggtttaggaaagagggtcttaacattgatctgcgtcttggtctggtatggagagaataaaggatggaccaccagatggagaaagggcatccaggccccatgcagcctgcagatacaggtacacactccattctcacatagttgtctttctcagctctttggctttcagaagtcggctttttgggtttattattacagtaagcttttccaatgacaacattagagttgtcatagcccccatccgtggagctcccatgtgccctaggaattggtccgccagaagccgccccctccccgtgtcaaccttcccagcctccctttgtgtggatactaattattccaccttgaaaaagagaaaacaggtgagtgggattaggggatgacagtagcacctaccccatagggtaattaccaagattaagtgagttaccaaatgcaggagcagttgcgtagtttcctggcatgggggcgctctgagggatagctgtgatctaaatagcagtccctttaaaactctacccctgctcttggacttctaggccatgcttcactgatacttccattttgtttttgcaaacccagcttccttcctacctctgaactgattttcccattaccgtgttttatttctttccttctaagatcataagcatttatctttaggcttaaaaggagaaaaaaaaaaaaggacttgttggcagtctgttttttttttttttttttttttaaatgaagtctcgctcttgtcccccaggctggagtgcaatggcgcaatctnggttcactgcaacctccacctcccaggttcaagcgattctgttgcctcagcctcccgagtagctgggattacaggcgtgcnccaccatgcccagctgatttttgtatttntagtagagtcgggatttcaccatgttggccaggctggtcacaaactcctgacctcaagtaatctgcctccctcagcctcccaaagtgctgggattacaggcgtgagccaccgcgtccggccttgttggcagtctttattgtctaagtaaaatgtcttactttggccaaacagcagaatgtgtccttggaaggcaatagctttaagtaatgtaactatcagtaagaataaagttgtgttgagttttttcatttaaagggatggaagaacaacaaaggatttggttcattctatcaaagtaagttttggcagaataaggactaggaggtatatttcagagtttttctttcgaatgtaacatggaaaatttgtcattttgaaaacaagcagggtatggaattagagggtcaagttgttgcttggttacagaaagaaaaaatttcattttgatgagggatatgtacacctgtggggagtgtgtgcatgtagttttctttttgctctgtaaagtactgtgcaaaagttgtgagtagagtagttgtggtgctgtctttcttcgtctactccatgggcttgagatttttgttgacagtcaaggttcacagctgctgctgatgtactaatatttggggaagc

SEQ ID NO: 249 - DNA, 282 bp, Homo sapiens
aactttttttcctggaattttgagtggggaatgtcaaattagcattttatcagtatctcaaacttggtatatatataactatactcctgatcttcctcccaactttcttcctccacagccttccccaggtcagttcttggaaactctattcttccagatgctcaaggcaaaaaccctggagtcattcttttttttttttttttttttggcagagtctcactctgtcacccaggctggagtgctggagtgcagtggtgcaatctcagctcactgcaaccccca

SEQ ID NO: 250 - DNA, 614 bp, Homo sapiens
tctaccctgatcatcacttcccactttactggctcatgccttctagtgccaacaattcttttatctcactgagacttagaacccattgaccctattatctttgcactgttcctcaccatactctctccttatgtccttacccttctctttattcagtttaatttctgttgttggtcatgattgttcagttgcaaatattctcagtacacttgccctcacttgcttcattgcttaatagagaaaccccagtttctctattaagaaccgcagttggttaaatccaactgtgcctactctacacttgtactttttaaaaatgtggtttagaaaaatggatatcaactgggcacggtggctcatgcctgtaatcccagcactttgggaaggcccagacaggaggattacttgaacccaggagtttgagatcggagtggacaacatagtgaaacactgtgtctgcaaaaaaattaaaaagttatttgggcatggtggcatatgcccgtagttccagctacttgggaggctaaagtgggaggatcacttgagcctgatgaggtttaggttgcagtgagctgtcattgcaccactgtactccagtgggtgactgagcctga

SEQ ID NO: 251 - DNA, 393 bp, Homo sapiens
ggcattactttcaatgtaatgtgttaagtaaattgttggagcaagctagttttattcttttcttccttgtttatatcctatgagaggagttgataatgtaattgagtaaaacacagatcatttattgggtcatattttaaagtagagagtgttactatacctccaatgccatgacccatgcatttccatatcctatccctagaacctttcacttactttcttgtattaaacagatcaaataggttccagaaacagacctggctcattagtgctaactcctgcattgtctcttgctgtttcggcttttctacatctgtgacttcaccatgtttggtctattctgagacccccaaatcttagttttctgaggaagagaacaggattcttgttgga

SEQ ID NO: 252 - DNA, 566 bp, Homo sapiens
agcaattctcctgcctcagcctcccgagcagctgggattacaggtgccagccaccttgcctggctaatttttgtatttttagtagagacaggcttcaccatgttggccagactggtctcaaactcctggcctcaagtgatccacccgcctcagcttcccaaagtgctgggattacaggcgcgagccaccacacctggcctacgtcttaactccaactccagactgagacctggctccaggtctaccgtgtcctctgagcccggctcatgatgacttgtggcccagaccccagctggttttgggcttccctctgtttgagctcttgcacagcaatcctccatacccccttcactgtctgagaacttttttttttttgagacagagcctcgctctgtcacccaggctggagtgcaatggtgcgaacttggcttactgcaaactctgcctcccgggttcaagagacgattctcccacctcagcctcctgagtagcaggggtaatttacaagcgtgcgccaccacgcccagctaattttttttgcatttttagtagagatggggtttcac

SEQ ID NO: 253 - DNA, 344 bp, Homo sapiens
ccttcctaagaaagggcaatatcaatggtagtcatcaatttattcctaacaaagcacctaacataacagatgttatgacataacagattccataaatatttgtggaataaatgaatcaatgttggtacctcctttggtccaacacagggcactatgagtttcctgatccctgattttccctgcaaagggatggaggcttgtcttatgtattcctacaacactccatacttcgcctagtatagcacttatgactttattataattgtttgctcccctcatcaacttctcacctgttgtggggcctataattaccttattcacctgtgtaatcccagcatgtagca

SEQ ID NO: 254 - DNA, 321 bp, Homo sapiens
cattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagat

SEQ ID NO: 255 - DNA, 225 bp, Homo sapiens
gcaaaaactgatagactgaaaggagaaaaagacaaatccataattttagtcagagattttaatgccattctcgtactagttgatagcacaagtggacagaaaaccatcaaggatgtagtagacttgttacaacactatttacttgacttgatttatagagccctctgtgcaacaacagagagacattctgctaaagtgcacatggaatattcatcaagacagacc

SEQ ID NO: 256 - DNA, 2199 bp, Homo sapiens
cgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcggaggagcgccgcgtcaaggtctccagcctgcccttcagcgtggaggcgctcatgtccgacaagaagccgcccaaggaggcgtccccgctgccggccgaaagcgcctcggccggggccaccctgcggccactgctgctgtcggggcacggcgctcgggaagcgcacagccccgggccgctggtgaagcccttcgagaccgcctcggtcaagtcggaaaattcagaagatggagcggcgtggatgcaggaacccggccgatattcgccgccgccaagacatacgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagggccaaggcgaaaagactgcaggaggcagaactggaaaagctgaaaatggctgcaaaacctatgctgccctccagcttcagtctccctttccccatcagctcgcccctgcaggcagcgtccatatatggagcatcctacccgttccatagacctgtgcttcccatcccgcctgtgggactctatgccacgccagtgggatatggcatgtaccacctgtcctaaggaagaccagatcaatagactccatgatggatgcttgtttcaaagggtttcctctccctctccacgaaggcagtaccagccagtactcctgctctgctaaccctgcgtgcaccaccctaagcggctaggctgacagggccacacgacatagctgaaatttgttctgtaggcggaggcaccaagccctgttttcttggtgtaatcttccagatgcccccttttcctttcacaaagattggctctgatggtttttatgtataaatatatatatataataaaatataatacatttttatacagcagacgtaaaaattcaaattattttaaaaggcaaaatttatatacatatgtgctttttttctatatctcaccttcccaaaagacactgtgtaagtccatttgttgtattttcttaaagagggagacaaattatttgcaaaatgtgctaaagtcaatgatttttacgggattattgacttctgcttatggaaaacaaagaaacagacacagtgcacacagaaaatattagatatggagagattattcaaagtgaaggggacacatcatatttctgcattttacttgcattaaaagaaacctctttatatactacagttgttcctatctctcccccgccccccaccgccccaccacacacatatttttaaagtttttccttttttaagaatatttttgtaagaccaatacctgggatgagaagaatcctgagactgcctggaggtgaggtagaaaattagaaatacttcctaattcttctcaaggctgttggtaactttatttcagataattggagagtaaaatgttaaaacctgttgagaggaattgatggtttctgagaaatactaggtacattcatcctcacagattgcaaaggtgatttgggtgggggtttagtaattttctgcttaaaaaatgagtatcttgtaaccattacctatatgctaaatattcttgaacaattagtagatccagaaagaaaaaaaaaatatgctttctctgtgtgtgtacctgttgtatgtcctaaacttattagaaaattttatatacttttttacatgttggggggcagaaggtaaagccatgttttgacttggtgaaaatggggttgtcaaacagcccattaagctccctggtatttcaccttcctgtccatctctcccctccctccggtatacctttatccctttgaaagggtgcttgtacaatttgatatattttattgaagagttatctcttattctgaattaaattaagcatttgttttattgcagtaaagtttgtccaaactcacaatt

SEQ ID NO: 257 - DNA, 2109 bp, Homo sapiens
cgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcggaggagcgccgcgtcaaggtctccagcctgcccttcagcgtggaggcgctcatgtccgacaagaagccgcccaaggaggcgtccccgctgccggccgaaagcgcctcggccggggccaccctgcggccactgctgctgtcggggcacggcgctcgggaagcgcacagccccgggccgctggtgaagcccttcgagaccgcctcggtcaagtcggaaaattcagaagatggagcggcgtggatgcaggaacccggccgatattcgccgccgccaagacatacgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagggccaaggcgaaaagactgcaggaggcagaactggaaaagctgaaaatggctgcaaaacctatgctgccctccagcttcagtctccctttccccatcagctcgcccctgcaggcagcgtccatatatggagcatcctacccgttccatagacctgtgcttcccatcccgcctgtgggactctatgccacgccagtgggatatggcatgtaccacctgtcctaaggaagaccagatcaatagactccatgatggatgcttgtttcaaagggtttcctctccctctccacgaaggcagtaccagccagtactcctgctctgctaaccctgcgtgcaccaccctaagcggctaggctgacagggccacacgacatagctgaaatttgttctgtaggcggaggcaccaagccctgttttcttggtgtaatcttccagatgcccccttttcctttcacaaagattggctctgatggtttttatgtataaatatatatatataataaaatataatacatttttatacagcagacgtaaaaattcaaattattttaaaaggcaaaatttatatacatatgtgctttttttctatatctcaccttcccaaaagacactgtgtaagtccatttgttgtattttcttaaagagggagacaaattatttgcaaaatgtgctaaagtcaatgatttttacgggattattgacttctgcttatggaaaacaaagaaacagacacagtgcacacagaaaatattagatatggagagattattcaaagtgaaggggacacatcatatttctgcattttacttgcattaaaagaaacctctttatatactacagttgttcctatctctcccccgccccccaccgccccaccacacacatatttttaaagtttttccttttttaagaatatttttgtaagaccaatacctgggatgagaagaatcctgagactgcctggaggtgaggtagaaaattagaaatacttcctaattcttctcaaggctgttggtaactttatttcagataattggagagtaaaatgttaaaacctgttgagaggaattgatggtttctgagaaatactaggtacattcatcctcacagattgcaaaggtgatttgggtgggggtttagtaattttctgcttaaaaaatgagtatcttgtaaccattacctatatgctaaatattcttgaacaattagtagatccagaaagaaaaaaaaaatatgctttctctgtgtgtgtacctgttgtatgtcaaacagcccattaagctccctggtatttcaccttcctgtccatctctcccctccctccggtatacctttatccctttgaaagggtgcttgtacaatttgatatattttattgaagagttatctcttattctgaattaaattaagcatttgttttattgcagtaaagtttgtccaaactcacaatt

SEQ ID NO: 258 - DNA, 1184 bp, Homo sapiens
cgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcggaggagcgccgcgtcaaggtctccagcctgcccttcagcgtggaggcgctcatgtccgacaagaagccgcccaaggaggcgtccccgctgccggccgaaagcgcctcggccggggccaccctgcggccactgctgctgtcggggcacggcgctcgggaagcgcacagccccgggccgctggtgaagcccttcgagaccgcctcggtcaagtcggaaaattcagaagatggagcggcgtggatgcaggaacccggccgatattcgccgccgccaagacatacgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagggccaaggcgaaaagactgcaggaggcagaactggaaaagctgaaaatggctgcaaaacctatgctgccctccagcttcagtctccctttccccatcagctcgcccctgcaggcagcgtccatatatggagcatcctacccgttccatagacctgtgcttcccatcccgcctgtgggactctatgccacgccagtgggatatggcatgtaccacctgtcctaaggaagaccagatcaatagactccatgatggatgcttgtttcaaagggtttcctctccctctccacgaaggcagtaccagccagtactcctgctctgctaaccctgcgtgcaccaccctaagcggctaggctgacagggccacacgacatagctgaaatttgttctgtaggcggaggcaccaagccctgttttcttggtgtaatcttccagatgcccccttttcctttcacaaagattggctctgatggtttttatgtataaatatatatatataataaaatataatacatttttatacagc

SEQ ID NO: 259 - DNA, 883 bp, Homo sapiens
cgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcggaggagcgccgcgtcaaggtctccagcctgcccttcagcgtggaggcgctcatgtccgacaagaagccgcccaaggaggcgtccccgctgccggccgaaagcgcctcggccggggccaccctgcggccactgctgctgtcggggcacggcgctcgggaagcgcacagccccgggccgctggtgaagcccttcgagaccgcctcggtcaagtcggaaaattcagaagatggagcggcgtggatgcaggaacccggccgatattcgccgccgccaagacatacgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaacagaaggtaaagccatgttttgacttggtgaaaatggggttgtcaaacagcccattaagctccctggtatttcaccttcctgtccatctctcccctccctccggtatacctttatccctttgaaagggtgcttgtacaatttgatatattttattgaagagttatctcttattctgaattaaattaagcatttgttttattgcagtaaagtttgtccaaactcacaatt

SEQ ID NO: 260 - DNA, 2442 bp, Homo sapiens
cgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggcctgggggcgccgagggggccgcggaggagcgccgcgtcaaggtctccagcctgcccttcagcgtggaggcgctcatgtccgacaagaagccgcccaaggaggcgtccccgctgccggccgaaagcgcctcggccggggccaccctgcggccactgctgctgtcggggcacggcgctcgggaagcgcacagccccgggccgctggtgaagcccttcgagaccgcctcggtcaagtcggaaaattcagaagatggagcggcgtggatgcaggaacccggccgatattcgccgccgccaagacatacgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagggccaaggcgaaaagactgcaggaggcagaactggaaaagctgaaaatggctgcaaaacctatgctgccctccagcttcagtctccctttccccatcagctcgcccctgcaggcagcgtccatatatggagcatcctacccgttccatagacctgtgcttcccatcccgcctgtgggactctatgccacgccagtgggatatggcatgtaccacctgtcctaaggaagaccagatcaatagactccatgatggatgcttgtttcaaagggtttcctctccctctccacgaaggcagtaccagccagtactcctgctctgctaaccctgcgtgcaccaccctaagcggctaggctgacagggccacacgacatagctgaaatttgttctgtaggcggaggcaccaagccctgttttcttggtgtaatcttccagatgcccccttttcctttcacaaagattggctctgatggtttttatgtataaatatatatatataataaaatataatacatttttatacagcagacgtaaaaattcaaattattttaaaaggcaaaatttatatacatatgtgctttttttctatatctcaccttcccaaaagacactgtgtaagtccatttgttgtattttcttaaagagggagacaaattatttgcaaaatgtgctaaagtcaatgatttttacgggattattgacttctgcttatggaaaacaaagaaacagacacagtgcacacagaaaatattagatatggagagattattcaaagtgaaggggacacatcatatttctgcattttacttgcattaaaagaaacctctttatatactacagttgttcctatctctcccccgccccccaccgccccaccacacacatatttttaaagtttttccttttttaagaatatttttgtaagaccaatacctgggatgagaagaatcctgagactgcctggaggtgaggtagaaaattagaaatacttcctaattcttctcaaggctgttggtaactttatttcagataattggagagtaaaatgttaaaacctgttgagaggaattgatggtttctgagaaatactaggtacattcatcctcacagattgcaaaggtgatttgggtgggggtttagtaattttctgcttaaaaaatgagtatcttgtaaccattacctatatgctaaatattcttgaacaattagtagatccagaaagaaaaaaaaaatatgctttctctgtgtgtgtacctgttgtatgtcctaaacttattagaaaattttatatacttttttacatgttggggggcagaaggtaaagccatgttttgacttggtgaaaatggggttgtcaaacagcccattaagctccctggtatttcaccttcctgtccatctctcccctccctccggtatacctttatccctttgaaagggtgcttgtacaatttgatatattttattgaagagttatctcttattctgaattaaattaagcatttgttttattgcagtaaagtttgtccaaactcacaattattttaagaggtgttctctgttcttagctgggcttagctcgaaagtgctacccacatgagggggaagctggtcttttttaatattttaatgtaagtcaaccaagagttgtggccagattcagccatgttggggtgattggtggtggtggggagtgaactgaaactactgaaatactttgaaatgtttcctctggcagcttgttacttatggaaaagaggtggaattgctgcgaggagtttttc

SEQ ID NO: 261 - DNA, 466 bp, Homo sapiens
  misc_feature (439)..(439): n is a, c, g, or t
tctaatcctcccgcagcctagagacaggcaggcgggcgaggcagccgggcgccgacgtcctctgctgaaggagtggagaagaccgaccgacccgagtggttgatttatgcatgcgttttcgttaactaggactgaaagtggctcctggctcttctgggaaaatggagaacgtggttgttatcaatggataccaatgacttcctgaaatgctcaacttgtacaaacaaaaaatgaaaaactttctccccttaatgtagaaacacatggcattttaaaagtaggtttttcattattgtaaagatgttttaatttttaggattatgtttttgtgaaagattcgagggaaaaagagcgatgttgagttttgggccggcggaccattatgggatttttactatagggctaggaacatttagtacttacttctaagggatgtttnccaatttagtaaaatgtataaagattg

SEQ ID NO: 262 - DNA, 213 bp, Homo sapiens
agtcctctgacttccccctgaacatggatttcacaaagtacacccctttatagccatagtgcctggattcaacccagctctgtcacctcccagctctgtgactgttcaagttacgtatactgtgtttcagtgtctacctagagttgtggggattaagtgagttagtacctgtcaagctcttatagctgtctggcatatagtaagtggtatttg

SEQ ID NO: 263 - DNA, 435 bp, Homo sapiens
actttttaatttttttctttatatagggcttagctctttaaagtatgttttatcttcttttttttgagacagagtcttcctctgtcgcccaggctagagtgcagtggcatgatgttgtctcactgcagcctccgcctcctgggttcaagtgattctccagcctcagcctcctgagtagctgggactacaggtgtgtgccactgtgtctgtctaatttgtgtttttagtagagacgcagtgtcaccatgttggccaggctggtctcgaactcctgacctcaggtgatctgcctgtctcagctttccaaagtgctgagattacagacatgagccaccacgtctggcctgttctatcatttgtagagccaaatctatttatgttagtgctaggttaatgataggaattgttatctaacttaagaggaaactgtttttt

SEQ ID NO: 264 - DNA, 260 bp, Homo sapiens
tcactgttaactctcagctaatcttgtctccatcctgccaccctccactccagattattttgaagcaaattctagacatcacttccttttattaaagcaagttgcgtttcatagtgacaatagaaaccatttactcttggcacaggtgctaaggtctgaatacaactttaaggagacagtgtctgcattgaagagcttatgttttaagaaaggagtttatgttttcactggatatactcggcgttcagggaatcagagac

SEQ ID NO: 265 - DNA, 474 bp, Homo sapiens
taaaccaataataaataatttccctaccaatcccatatgtacacttaaaaaatatttgccctctcatggaactattttaatattgttcagccaatctcttcctgagcttcactcacctataataattaatgccctttctatatagagtcaacctcaaccaaaaccagaaacagttttcaccagagcctaaaatctgcaccatcagcaagtggaggggaccaggggtccatatgcttcctgtttcacccccatcatttgcctgttgaatcattgctttcctctcaccctagttgtatggagcgaatctatgtatacatccagacatctgctttggttttctctaattatttcaaagccatctggatatagagcttttccctacacccaagcccacttggctggggccctgacatcctgcctagctttgacaggcttgtctatggaggtagagctctgttacctggacccttccac

SEQ ID NO: 266 - DNA, 390 bp, Homo sapiens
acctatattttctgtttatcctacatcaagaatgaaaccaaatctactgactcttggcttttatggctatatttattttaggcttaagcatttttttttacattacatgttttctatttcaaaattcgttgacaactgcattcagttttacaacaattcatagctttagctccataataatttttttttttttttgagatggagtgttgctctgtcacccaggctgcagtgcagtggcacgatcttggctcactgcaacctccacctcctgggttcaagtgattcttctgcctcagcctctctagtagctggaactgcaggtgcacatcaccatccctggctattttttgtatttttagtagagacagggtttcaccatattggccaggc

SEQ ID NO: 267 - DNA, 896 bp, Homo sapiens
tggaggcccagccgggtgagtggttctctgcctcagtggctattcatacccatcctgaagaagaccaggtctcccagttgacgggagttactgactcacagtctagatgaggatttgtattgggcagagctgactcggtaattccctcacccactctcctctcaactccttcccactgtccttgcattactcctgatcttttgaagtaccagaatcaaatatctgaaaactgcctaaggggctaatctcccaggaatttgttgttgactgctgattataggaagaactttgaggagcctgccagcaattgcatgcaggcagcactgcaggttgaaatcttatattctttttattgaacacagacccagaacacgggcagcttctgcaggattgctgcagagcacaagtgtttcccatctgggctcctggtatattcgctgcccttccaagactctgggatctgaaaggaagatgctgtggcttttcataaacaagcagcaaagggttgcattcctcctgatattgaaggatatttaggagggtatgtgatgtggtatgagataggagccccgagtccttttgcagcattgcaaacaggttgtttgtgtgcctttgttgatgcgctgctggcgagccctgacaactgagaattactctgcagaacgaaagagcaaacttgagctctcagagcttaagcttggactttttttttaatggacagagttatttttttataaaaatataaaatgtttttatattgtgtttatttttatttttgtcaaattattgtagcaagattgagtattttgcaaaaggaaaaaaaatcacctaatctcatgatgctaaccatacgaccattttttttttgagcctgggcaacagagtgagatactatc

SEQ ID NO: 268 - DNA, 513 bp, Homo sapiens
atcaaattttatagggaggggttctgtttctcatggtatattacgctcagacaatgcatattagggcagagagagaaaatgagacagcccaaaatcatgaatatccaaagcagcccaactctatctcttcaaggctatgttgaaccaaaacccccttgtgagctgttctgagttgcagatctgtttgcacatgagcttggagcatactgggtaaacaggagtggttggtaaattctatttcacttcaccagtgagctgaaaaagcattgggtaatatgttatgagttgtagatctgtttgattgcattgttgcaaagtgggaattgttttgcaacatagattcttaatcacggaggcatctatgattgaatgcgtcgaaaattggctgaaattgaaagttaactatactgcagacggcttattctggtgtataattgaaaataaattctaataactcttcttgaaagagctgctcagaggaaatttcaagccccctggaaaaaaaaaaaaagt

SEQ ID NO: 269 - DNA, 297 bp, Homo sapiens
gcttacataagtaacaggtgtgatcaataatcgtagcttttaatgattatgtatgtgatcactgtgcctacaatcatgtttatcaacgtctttgtaacaccctagcatgacttcaatattctcatttatcttttatttttaaatttgtgatacagcaatttttatgtatgtgtgtccctctttttatgatctttatttgcttcttgaaagcagtaggttatctgtcatgtaaattttcccagttctggatttggttgcatagcatcaattaaatatgttcacccaagtcccatgttt

SEQ ID NO: 270 - DNA, 261 bp, Homo sapiens
gcctgggacgccatcctcctgggtcttctccaatgagcccagtcacctcatctgagaagccctccctgactgccctgcctaagggaactcccctagtccctagctcttaccactctccaaaatcacctccctcgtatatttattcactctcttttctctctgcactggtaagctccgtgagggcagagtccatctgtcttgtcagggcatacagcagacacacgcatgcccaatggatgggtagctgctggtggcactcca

SEQ ID NO: 271 - DNA, 180 bp, Homo sapiens
aaagatgtagtaagaactaaagctactctctgggctattttacaagcaagtattttttattcatgggctggttgtcacaaaactttctagtaaatcaagtatcttctttcaagaccctgattttttacctaaaaaaatccttctgctttatttgaaccaaccattcccagggagcttgct

SEQ ID NO: 272 - DNA, 425 bp, Homo sapiens
caaaccaaatctaattgcaaattgaaatatgttctgtggaagaaataaatggggacacttgttaggatagtcaaggaagggttatcttcctgagaaaacatttacactgagacctgaaagctgaaaaagaagtgggctaagctcctctacttttggagcggttcctttccatgtctcaggtgaataatccagcagtgggccaacgagtatacatcgagcaactgtctactactatgtgtgtgcctcgtgtatgctggacgtcagaagtacagtgaaagatgcaaccacgcaagtatacggtaggtttctgccgttctctgttctctggagtgcctccggagagcttctccgtctcaggcccctttgaccccatccagagctctcccttctaggactccacactatccgttcccccgcctcgcccc

SEQ ID NO: 273 - DNA, 325 bp, Homo sapiens
ttggtcaatatttcacctatttttgaagttttactatttgcaaatacattgttttctttgtataaaatacatctaatgtctatacactagtaatattacttgttctcagcttcaggaaacactttacagctgtaagttgaacaaacactacgttgttaaacatgccattgttgtggtgttaaatacatcaatagaaaggagaagatggatctgttgcatctgctgccactgctctataaatttatttttatttcaaaagttcttaccaacaatttatttaaaataaacaattcctgagatttacattgcactatcccagtttcag

SEQ ID NO: 274 - DNA, 387 bp, Homo sapiens
aactaaatgttttactgcagcttttcaaactgactatatttaactgattatatttaaaactgattaactgattatatttaaagctcccttggggaatgggagctgtgaggaaagaagctttggagaagacctttgttggcatgaatgaaaaattgctcagacctcccaagggaaagagcttgtttatataccagccatcaacattcccaagtatatatacatacacaatacgactccagttttaaatttcatctcctgctcttgaagggtcctgaaagggttaaactgttccaagcaaaggcctgcactttttctatcaaaatgctccagatggaaattacaaaatttcgcttccagctctgtggtgcacacacactgttctcctaa

SEQ ID NO: 275 - DNA, 457 bp, Homo sapiens
gatgtatgcaaaatcaacttggattttaaaaaggatcactgtgtctaaaatatgcagaagaaaagggcctatagggaaaataggatggaagcaggaagaccagttaggaggcttttgcagttgtccaggcaagagatgatgatgggcaggcacggtggctcacgcctgtaaatcccaacactttgggaggctgaggtgggtggattgcttgagcccaggagttcaagaccagcctggacaacatggcaagacccctgtctctacaaaacattaaaaaattagccaggtgtgatggcaatatagtgaaaccccgtctctactaaatatacaaaaattagccgggcatactggtgtgcccctttagtcacagctgcttgcaaggctgaggtgggaggatcacttgagcatgggaggctgaggctgcagtgagccatgattgcgccactgcactccggcc

SEQ ID NO: 276 - DNA, 243 bp, Homo sapiens
atttttgtcatttttagtttatgtggcaagtgacaggcacggacatgccatcattgttatagaaaaagctgtgaaagccatcaagtctggccgggcactgtggctcacgcctgtgatcccagcactttgggaggccgaggcgggcggatcacgaggtcaggagatcgagaccaccctggctaacaccgtgaaacccgtctctagtaaaaatacaaaaaaaaattagccggacgtggcggtggg

SEQ ID NO: 277 - DNA, 465 bp, Homo sapiens
tgctttctattaatgacaaatgatacgttaaaaaatatataagcaagcactaatagtttaaaaaacaatgctaagtatataataaaacgtggttcattcattcttgcgttcaacaaatattcgtccaataaatatatgtagagcatctcctatgggccaggatcttgccaaaggcacatctgcgaaccaaggaaacccctgccctcggggagcttgcattctaggcgtgggagtcgtgatggtggtcggagaaggactggatttggggatttgcttcttgcgggggacacaggcctgcccgtggggcccgcctcccgcgcggagagcgctgaggggtccggagtgacctgtaggctgagaccctggctgtccccttgcctagaggccgggcaggaggcgcggagcccgaggtcgcggggctgagggcgcggggcgggcccggcggggctcggctgcggcccgggc

SEQ ID NO: 278 - DNA, 268 bp, Homo sapiens
gatactagaggccaggaaggggaaaggaaaggaagagataagtagagatttgttaaagaatacaaaattacatctagatgggagaaataagttctagtattctgtatcactgtaggataaccacagttaacaacattatattgtatagtttcaaatgactagaagataccaaatgttcccaacacagacatgttgtttgagacgatggatttgctaattacctaggtctgatcattttatatatatattgaaacattactgagcaccc

SEQ ID NO: 279 - DNA, 434 bp, Homo sapiens
cagtcatggtagaaagggaagcagccagtcttacatggcggcaggagagagagaaaaactaccattaataaaaccatcagatctcgtgagaattcattcactatcatgagaacagcatgggggaagctgcccccagcatccaaccacttccctccctagacgcgtggggattacaattccagatgagatttgggtagggacacagagccagcccatatcaagcagggaaagctgagccctgggagaggtgagccgcagtggctggggagaaatggcttccctgtccaggcctggagacctggcatcagcagacagtgcccaggcctgccaattccatggactctgcagtgagcaacagctcagcagcacagccgcccgcaggccaggcccagagctccttggcgaagcaccctcctagaacgggaggaccacag

SEQ ID NO: 280 - DNA, 345 bp, Homo sapiens
aatatagtgatttttgtctgttcttttactgctatattttccagattttctatatacacacaaatacttttataatgagaaaaactcattaaaaaagtagagacaacaaaaaattgattcaaaaattggagcatattttggcctgtgtgtggcccaggcaggagctggtaaagcttcctgcggcttctctgctcttgggtggcgaggctatgataaaccatccctccgcttgcctccctctcgcttggtgagataggtcaaaattttaattctcccactattaatcctcaaatctaatttaatttcttatcagggagggttacgactgatttaaagttcatcaga

SEQ ID NO: 281 - DNA, 248 bp, Homo sapiens
caaagtgtttcaggagtgtgcatggggacactgctcagccctcaagagccttggcctcgagtcaagtcgtgtttgctgggccaccgctctgggagctgctgcttggtccaggccgtccggggggcaggggggagcagtaagtgcagctcaggctcctggttcagaggggttaggctgggtgaggggcaggcagatgacagaaccacgaggttcactagaggcaggatgtgttcccagctgtccttaac

SEQ ID NO: 282 - DNA, 282 bp, Homo sapiens
ctggtaaggaattaaataccactgttctcaacagtatttccatattagaatcatccaaggagtttgtttgtttttaatgatgttgcttgggccctaccccagatctgaattacaacccctgggaagtaggacctagtatcagtatttaaaaaatacttccctgccgggcatggtggctcacgcctgtattcccagcactttgggaggccgaggcgggcggatcacaaggtcaggagttccagaccagcctggccaacatggtgaaaccccatctctactaaa

SEQ ID NO: 283 - DNA, 352 bp, Homo sapiens
ctgtttcccaaattcatttgacctagaatccgtctttcctaggattcctcacagagtagaatgtgaggaacactaattaaaaggtgagaaaatggaagacccgggaagtgagcaggcttgcccaagcctccctccctgttaggggaggaggaagtcttcagacaggtgaaggtgtcttcactgattcctagacgggtgtccgtgcctctgcatcccctctgctgatgctgagagctggagatggtgcatcccgccagtggttgtataaggtctgaatgctagaatctttagggtttggtttggtttggtttggttcggttcggttcagttcggtttggagacagggtctcgg

SEQ ID NO: 284 - DNA, 389 bp, Homo sapiens
atggcatttttgtctcccttccttcccactccagatgacaagaatcccttcttttagatgattttctctaatggatgttttagaagattttttaaatagctgaccaaagtaaaatatatacaacttatttggggaccatccaagtggtttttcataacagaccgaattattagtgacacagatgtgatcccttaaattggcattaaaggaaaacctggaggagggagctgaaagaagtgagttgtatattaaaaacctgggttcagaagggcacagtggctcacgcctgtaatcccaacactttgggaggccaaggcaggcacatcacgaggtgaggagttcaagaccagcctggccaatatggtgaaaccccatttctactaaaaata

SEQ ID NO: 285 - DNA, 544 bp, Homo sapiens
aaacatatagttattatgttaaaatattcatgacacgtattaaagatggtaaggcagactttattcaggggtactgctgcaatgaagttttgtaatgggggtaagagattgagcttaataacagggtatgctgaatacaaggataagtggaaatttatagctaagaagcaaagtgggagtcagtgggtggaaaattgccaagaggaaacatcggagtaatgggaattgtggataaattgattaggcaggattattactgaaggcagccagggtgataagatattgacagtgaggcagggcagtggggcaggaatttgatcacacatatcaatggtgggagaatttctgtaaactgactcaacaggattcttgtgaaaactggaccaagcggagatgaacatggaaatcggaaagtcagggccttcttgtgaagagagttcaggagagtctgactagagttaggtaaggagagaatctgtcaactgaaagtccctttacaccttcatagtagagcaaatgtttttctggttatgtaacagtggat

SEQ ID NO: 286 - DNA, 380 bp, Homo sapiens
ttggcctcccaaagtgctgggattacaggcgtgagccaccgtgcctggccacacccagctaattcttatatttttagtagagacagggtttcaccgtgtcgaattcctgacctcaggtgagtgctgggattacaggcatgagccaccacgcccagacaaattctactatttctaaagtagcacttctctccctcttccaactaaacccagggttatatcccagtaagcagtgctctcaaggctgtttcagaaaaccccacccttcccttgagatccaggccagactcctcaagatggctgagaaaacaatctgcaatgagtgtgaagggctcagagaactgctgacaaagctctgtggagctctgttccaacccagtgct

SEQ ID NO: 287 - DNA, 471 bp, Homo sapiens
tgcaccatgtgtattgaaacacacctcagacatagtgtttagtttccctcgagcaaataaacatctaggcaaggaaaaaaaaaaactttaatagcatttactttttgtttcccctttgatgctggtttatttttgaatatagctgttgaaaataaagcaacaataaaaccaacgttgaatggattattaccctaatcttatttcttctctgtttttgagaagaggcataccagtgcacacctgtgtgtgtgttcacacgcatgcatgtgtgtgtgtaatgagagggaaataagaatggcctaagtggagggctaagaagtatgcacagaatgtgaatcccttttaaaattatctaccctgcttttgaatttaggcttcaatttaccatcttggctcaatacaggcaaaattttagtgcctcctttttaccactgggaaagtcaaatcaaagttccaataacagaaaaaaaa

SEQ ID NO: 288 - DNA, 450 bp, Homo sapiens
gggcggcgcttccctctcgccgcctaaggtcggaggcgcacgtgcccggggccgctaccacgtgagcgcagcgcctgagggcgcccagcactggccgcggctcgtgtccgggcttcgggagctcctggttccttgctctattgggctgtggctgaggtgatccgcgctcagtgtggacgcacaagtaacttcgtaaaggttgcatggtggttggggctaacctagcagagcggtttgtaagcggaaggcacgttaggttccatcccaagaggtgtgggctttagcgaagcgcagaggaagggagtggacaaagtcaaatatatctagggttctgcagattccgtgcggggttgctctgtgactagcttttcttcccttccataactagataagcattattcaccctctcttgggcctggaggaaggagaggtgtacacaatgaagaaaaa

SEQ ID NO: 289 - DNA, 387 bp, Homo sapiens
cttctgacccatacctcctgggtcctgaccatgactttcttgaaagtgtagtcccaaaattctccttacctctgaatctacttcctctgatccctgcctcctaggtactaatggttcagactttcctttcctctagcaagttgtaactccaaagggatctaaggaagctctacactgtgtccttaggcatctaggctataaacccagggagtcttatccctggtgtccctcccaatttaggtatacagctctcaacatgggctgtatacctgccccaagtttgtaatggctaagagagagagacagagaggagagagagagacagagaagagagacagagagaaaaagagggagtcaaagagagagaaatatagaaatagtaaaaaa

SEQ ID NO: 290 - DNA, 385 bp, Homo sapiens
  misc_feature (383)..(383): n is a, c, g, or t
cacttatacgtggaagctaaaaaaaagttgattcatagaagtaaaaagtagaacagataatactagaggctgggaagggtagggggaaggggatagagaaaggtttgtttaacaacacaaaattatagctagataggaggaagaaactcctagtgttctatatctgtagaatgactgtagttaacactaatatgtagtttcaaatagctagaaggaggatattgaatgttcctaaccgtatcaccccatctctacaaaaaataaaaaaattagccaggtgtggtggtgtgcacctgtagtcccagccacttggggaggactgaagcggatcacgtgagcccagggatgctgcagtgagctataattacatcactgtactctancc

SEQ ID NO: 291 - DNA, 851 bp, Homo sapiens
caggctggaatccttgagggtggcattatcaaatgaggaaatggttcctttcatttttcatctgaagactcagacagcaaacatgttatctggccctataagcaccccgatgcttctgtgaaacccaagcaagttctgcatcaccacgacagccgcggatgtcaaatcatcaaaacagcagcagaggaaggggtttattcctcctccaaatcttcagctggttttatagggttaccagtttaaagtttctttgttttcagagcatcagacctcccatttgtagctgatagccatttttcaaaggtttctggctcacccaggaattcattagggtggacgagaaaagaacagtggatagaatagaccagcagggcaatctaagccccattccctgtctctttacattggttcttggtccccgtgactcatccaaactcccttatattcctatctggaatgcgaaagctggaaatacaagtgctctgtaatcacaggcagtggttttcttggagtctggtgtgatttctgtagcttgcagcaatatgtgggacacacttgcactgaagaatttaatgacttgttttactgctgtctgccatcaatatttatctatattaactgaagaaaggcattactcgaaatggcatttcacacctctgagcattatacagtaattctaaagtcatacgttgtaccaaattctctgggcaaacacagagatacagtatgaatggaaagaatccaagttgaagtttttaaaacttgaattgtctgcagtaatctggaaaaccaaagtcaaaatgactcgaattgctatggctgggaatgactggattaaaagcaatggaaac

SEQ ID NO: 292 - DNA, 341 bp, Homo sapiens
ggcacaaaagaaagatctgtttcactttttgaaaactgaaaaatttctgtccttgcctttgcatgtcctagttgggtgttatactgaaagtgaagatcataaattcaccaaaacatgtatgcctttgtgtatgagcattaaaaaagttcttcaagttttccctagcctaagcatttaaacatgtcagcaaaaatacaaataaaaagaaatagctaactgggtgtggtgggtcccacctgtaatcccagcactttgggaggctgaggtgggaggattgcttgagcccaggagttcaagaccagcctggcaacgtgggcaacatagtgagacttcgtctcttc

SEQ ID NO: 293 - DNA, 481 bp, Homo sapiens
tcaatgttcatattgatgcaaccgaattgagatggagcagatgacattgttccttaaaccgctttgcctacaggatccagtaattccttaagaagacataatgcacttggtggtgtggcctctgcctgccctgctagacagatctcttgctactccaatttttaagctctaacttgcttccaggccttccattatgcttttgcatctgctgtggaatatcctaaactggaccaacttagaataggtcttcagacatttgttgaaattgagaaagagaagctttttttctttctctctttctcttttttttttttttttttgagagggagtggagttattaaaaactcctggagctgctagtgagtatcttctcactgttgagaggatggccttctcaagaatgaagccagtacccgccaggcgctgtggttcacgcctgtaatctcagccctttgggaggccgaggcaggcggatcacgag

SEQ ID NO: 294 - DNA, 585 bp, Homo sapiens
ctcctgtctccctgtcccctccgtgaattctggggtttcccagacttctgtccttggtgacaactctaactccatgtcccccccagatttcagaccaaccctcccccaagctactgacccatgtagccagttggtttctagcaatgtgggcatggacatcccactgacaccttgaattaacacaaaggaacagagtggtccccttctggctggcaggccctgtagcccctactctgggaagctggaaacttcgatcccctgtagccactccccacccccatcccgtctgctggcctccggctcctctccaccccgtcttcttccagagatggaatgtgggagacaattcctaggacaatgaaaggatcaagacactaactttactaacatcaatttcagaaagagaatgaggcaaagaaaatatccaataaatgatatgagaatattttcaagaactggctcaggaaatgagaagcagtcggagacacagcagatgactctgcagagacccagaagaatgaagccaagcccctgaacaggtggggagggggtgccaacgagaagcgcgtccggagacggcaggag

SEQ ID NO: 295 - DNA, 403 bp, Homo sapiens
aaaaagagtagcaggtgtagtatgcttagagctgggtttatgtaagcaagtgatagcagatgcttataaaaattggaaatgattatggagaactttaatattcagctgaaggaatcagagaatgatataattgttcatgtggatgggcctttaggaacaattttacaatgaacaattttacagaaatggaaacaagcttgtacttaatcttgtagccagtagagcatcatttgaagatttttgagttaggccgtttgaaattgggaaatatgtatttggtcttcaactccatattcggacatacaactcctataattcttagaaactccaaagtgacgtctgtttgagtgctaatgggatgactgttggctggcagcccctaggtaacttcaagatggggctg

SEQ ID NO: 296 - DNA, 412 bp, Homo sapiens
ttatctctagaaattgtattcttaggtagctgaattgtcatatttcctatttaaattttaatcacttaggagtctttaggaccttaaaattgggtgtgatgttgacactattgggttgacataatgaatgttaatgaattataaaaatactgtattttattgattctataatcaagacacatcctgtagtcagtggcatcttaggttgaatgaactgcagtagtctctctttttttttttaaatcaaaaggccaaattaattgtgaaaaatgttaacttaaaatttctcagaacttttggcttcttaattgccactggaaaaagaagtatcagtatcatcgccagctgtgcaaggcttgcatgtttgtttgtttgtttgttttttaatgggacagtgtctctctgtcactca

SEQ ID NO: 297 - DNA, 442 bp, Homo sapiens
ttccttcctcaaaatctcacctcccaaattgcatcccttcaggaaatgtaggtttcagcgaggcttggatttaggcagttctgggttcatattcctttctgctgcatatcgtatctgctgtgtgttgggcagtgtagggacactttctaggactcagttgtaacatgggattatgtctcttctgcatagggctgttttaagactgtgaaaacacagtgttgtatgtaacacgctagcacaggaccatggagttgagctcagcagttggtagctattatttcaataagctgattcaaatcactctgctaaagatatgaatgactaaaggatatagtcatgcctgtcatttcagcattttgggaggccaaggcaggagaatcatttgaggccagtcattagagactagcctgggtaacatagggagacccctatcaaaagacga

SEQ ID NO: 298 - DNA, 466 bp, Homo sapiens
gtgcagccgttccttctagctcgcgaggaaggcgcgggtcctgccttttgggtggcagagccgggggcattttcgcaagtcctgaacttttcagagagactgaagtcagggagggccgggccccggccccggtcccggccccagccagagtctttcgggatagggtccagggagctgaactcaggagatgatgcaggaggagccagcagcctcttctgccctgggagggagaacgcggtccgggtccgagctgagccagaagtttggcctgaggctgggacctcagcagttagaatgtggtatcttatccgagataaagccggagtttgcgtctctgtgggcccttcttggggacactctggggtatgggaagagcagaccgtgggggagagcactgggcaagccgtacctgtaatgtccgtggaggcgacgcgcctgcaagaaccagagcaaggagacactggtg

SEQ ID NO: 299 - DNA, 406 bp, Homo sapiens
aaactctatctcagaaacaaaaacaaaacaaaacaaaaaacatgggagatctcaccactcctcttctgtggttagaacaaaggaggaacacacgcagaaggagggatagggccttacaactctccctgccagcctggcctcatgcatgttcattaaaccccccagcaactgcagggtgcacattcttttcaaatgaatatggaatattcctcaagatagaccatatgctggcccatcagacaggtcttgataaattcaaagggattgaaataatactggatatgttctcagtgaaatttaagtggaaatcaacaacaaaagatagctagaaaattctcaattatttggaaattaaacagtacacttctaaataaaccctgggtcaaagaaattaaaaagaaaatga

SEQ ID NO: 300 - DNA, 393 bp, Homo sapiens
acacttaaaaaggcagaaagacactggcctttgagatttcaaatcttaaaaatccctccttggaaccactgggaaggtgagtaggcccttaagctattctgtaatttaaaaaagcaagaatattgattttctaaaatcgatacctgccaagaagattttggctactgtatttcttcctatgtacatctatactgatagctgcactgataaaatgctaggaaacccaaggtggttaaaaatccaatttctggcctctccttattgaggcacaggctgcataacaagccaaccgtccttgaagaatttgcaaaatgaaccccaaccagggcaagatatcatctggggtctgaacacaatgtggggtatgaatccccagctgaacggctcccctgg

SEQ ID NO: 301 - DNA, 362 bp, Homo sapiens
tacttgcaccgtgctacaaaaaggggctccgtaaatatttgttgagtcaacctgtgttatttcacctcagtttacccttttatttgatacagatgatgatccctactccgtctacctcacagaggtgttaagaggatcaaatgtgacaagaatataagtacactttatgactcggaaagcattcttcaaaggtaatgttcttagtccaactagcacagcccaagcacccaagatgctggcactgttgcaaagccctagattccagagctgttttgggcatcacctgtagtccactctcctgtctgtctagaatgctgggcaaaaaagaagaaacaaccaaccaccaaaaacttacatcatcc

SEQ ID NO: 302 - DNA, 370 bp, Homo sapiens
attacacactgcagttagggaggaaccaagaaccagttgacaattctgtttgtttatttcaatatgaactaaaatttggagcacatttttaaagtatgtagttttagctaaaaagagaagtgaaactttttctggctcatatcaaagattagcttctacagcgtctttttttttttttaactgtgcaaaaatacacatacaatttgcccttttaaccattttttgtttgttttttgtttttgagatggagtcttgctctgttaaccaggctggagtgcaaagcgcgaccacagctcactgcaacttccgcctcccgggttcaagcaattctcctgcctcagtctcctgagtagctgggactacagccatg

SEQ ID NO: 303 - DNA, 312 bp, Homo sapiens
tttaaagggaaaataatacactgacaacttatctaaggaaattctattcacattacagaaagaactagcagcagcaacattcacagtgattcaagcacaaagcggttcaatctttcatatggaaattctgtttggaggcgaaaccgtgtcatgctctattttgggtaagtagctctcaaaactcaagggggaattacaattatatatctactccatactaccttattatctactccttatttcctaagcacccccaaccctagtccaaatcagttggatttaaaaggctattttataaagaattataaacca

SEQ ID NO: 304 - DNA, 393 bp, Homo sapiens
acacgggaagataccgagactcagggagagaaaaaaatgagaaaccagagtcattgggtaacagacatgggaaagacatagggaaatgggaagacacagtctcatggggagattgagacacaaaggaggtaaaaagatttaaaaaaaaaaaaaaaaaaaagaatggaaacagaattgccaggttgccaaggctttgtggaagacttggagacccaagctatgggagagatagagacttggggagaggctttaaaagaggatgctgtggccgggcacggtggctcacgcctgtaatctcagcactttgggaggccgaggcgggtggatcacctaaggtcaggagtttgagaccagcctgaccaacatggtgaaaccctgtctctactaaaaata

SEQ ID NO: 305 - DNA, 375 bp, Homo sapiens
agtagtcctagatttgtgtgatgcattcttattctagcccacatctcgctttgtgttgcctccctgtatatcttataagctgccccaagacttcctctttaccattctcaaacccacattggcttgactccttggctctgagctcttgcttgttctccagcatctgaatcactttcctgcactggtgttggtggcctatccacttaggtatatcacaggcagaaactatcttgtgaagcggcctatttgggcaactccagctggggaaccaggacttctggaactctctttttggctccagctttaaatgatagggagataggacatgcaggacacaccaaaacagcccaatacagagtacactaaaaagatcgt

SEQ ID NO: 306 - DNA, 759 bp, Homo sapiens
tttgttatcttaataaagtgtacttctgattaattatggaaaaatccttttgcttccaccaatgataaaatttgggaaatattatgtcttttacaattatatatttaagtaataagatttaaatttataatttcaattttaaaatatgatagcattagcaatgtccttattgtgtgtcttcctcccttttattcattcatgataggatttagtttactaattttggtgaataattattgaatatcttgtagaaagcagaagtgatctgggggagaaagctgtccagagtgctgcgaacagacataggagaaaggaagcacagaatatgattggataatagtaatagaaatagaaaatactaattttggaaatcagcaagtatttactggaagggtagtatagcatgataagactatgactcaaacagatgtgagattgaatcccaacaatgacaccttggacaaagtgtttaatcaccctgagtctcaatttattaatctctacaattattcttactttattttaagattctttcgagtatttgttgtagaatgcacagcttagttaatggaatttttgaacatacactaagccttgacacagaagtatgagaaagatgtaaatggatgtgctgaaatgtgaaacatagaaacattgtcatgtgaccctacagtactgctattttctaaacaggttttctgtaattagactgtctcactcatgtgtaagggttccatgtatcttctgaactaaaatagt

SEQ ID NO: 307 - DNA, 571 bp, Homo sapiens
cctaactacgaacgctgtgtgattttgccagtgtttactactcttacaacattatttgccactactcttacaagtccttgccagtgtttagtaccattacaacaactactccccctactattgctgctgctattatgaaggaggagagggaaagaatagcatctgacattctttgagtgctggctgtgtgccaagcacagtattcagttatttacatgcattatttcatttaatcatcacagtctccctgtgaggtaggtactgttactatgttgccaagtgacagaataggaattgaagccagtcgttcagactccaagtctgaggacttaaccactacactagtatcttccctgaatacttaaggatgaaatatcttagaaaacaaaactgctgctctattagaagtcacataaaactacaaaaattatttaaagcaacaaacttgaggccaggtgcagtggctcacacctgtaatcccagcactttgggaggccaaggtgggagaattgcttgagctcaggagttcaagaccagcctgggcaacatagcaagacctcgtctctagttt

SEQ ID NO: 308 - DNA, 444 bp, Homo sapiens
ctatcacactatgtttacaaatcaatttagaagtatctaagctaaggttgagggaaaggaatgttgctgtggaaaatgattccccagaattgatgttcagccagaatatagctcatatatagaagtatgtctgtactgatcattatatggaaatacatgctagttgaaaaatatctgccctctgagccaccctatcctcagttattcaggccaactctgcctggggagccacaggtgggcacctagagggcactgacctggtaccctctagcctgccaagcctaccagccaacccatcttggttgctgcttgccagtccccatctcaacctttttctctggtcagagcagatcacagcagaatagacaatggcccaactgtggcaatggcaccctcacagggaaatacccagtgcccatctgcacccttcgtcaaccaggctgt

SEQ ID NO: 309 - DNA, 379 bp, Homo sapiens
tacatcacagaaacctcagataccgcctctgtaaatagggttaaagatgccccactccaaaaatggttgcaagctcaacacggctcctttccagacactcgaagggcgcggaccttcgctgagacgccacccacgcaagtggaggaagcacttgcgccactgctgagcggttggaaggggaacactgcaggtacgccccagtcaggcaaggaggcaggaccaaagccctgagctctccggaggctggcggggaatccccagaggctatctgtagtcccggctgacccctgagcgggtgagggggcggggggcgggatgtgggagtgatggggggcgttgagcgctgagaggatgttgtgggcgagccgcaggccctccc

SEQ ID NO: 310 - DNA, 315 bp, Homo sapiens
agctttccagggtggtagttacttatgttcactgtcctttggaagagacagagatttgctttctagcagaaatggaaaagtaaaagtgttacagatgcattgtgggaagcaacgggagggaatcacacaactgaaacggaatgcatttatcccccttctccagtggcccagctgcggctcacctagtgtctccctgtggggggcaggctgctgtcaaaaaagcgaaattgaaagcccagttagactcccactttagccttttttagctggcaagcacgcttgaagcagctaggctgcaaccacaaggggttacca

SEQ ID NO: 311 - DNA, 454 bp, Homo sapiens
ggcatctcagactcggtcattaagctattgttgcaccctccggaaaacatggcagagcatgacctttgagtaagagtgaggatgaccttgcagatgactgtgcccattcgcgctccatcctcatgaaggaaattgctgccaaggtctgtattttgaccaggcacagagggggaacatcactccagctttccatgtggttcactctgatgcgatgctgtaaatgatcaactctttgaaataggaccctcaggcccccatttcctagcagccccccttcagtttggttctacaactcaaccccttcactgcacattgagatggctcaggggttctagcaggggcttccagaaaaaaaaaacaccatttctgtcccgggggaccagttctgagctgtgctagatcatcacacgaccacccagaaacccacttgcacttcctgctggatgatcaggca

SEQ ID NO: 312 - DNA, 772 bp, Homo sapiens
ggtaacaggattcagaagccagaagcacagtaccacacagtgagcaattccccagactcgtctctttgagcttttcactagaaaatccttcttcacctctcctttctcccaattcctttttattaagagtcttttaacctggatgaacataatttgagccgatcataaacaaatagctctcttttttgcctgactttatgcatttctgttgccatgtaaaccaaataaagctagctgtgagcaaaccagctgctgcctgcagcctccttccctagaggaagggaaagggtggtgaaggtaattgggaaggactataagaagggtagaaattgagggaagagagtattctatttacatttctggtcctgattctcactctgtttatttggctatttagaatatgatgactatagttgacttagtcattcttcccagcagctgagagatatgggtgactaataattttttctctatttgtttgcatgttggaaatggttactattgaggggtggaattaatagagtctaagctatatttcagaactggaaaacttggaaaatgaatggttgtagggaatagcatgggatttatgattttttgtttcaaagagttacgctttgggtactggcattaaaaagtagttccaggggccaggcacggtggctcacgcctgtaatcccagcaccttgagaggctgagtccagaggattgcttgaggccaggagttcaacatcagccctggcaacttagcgagatctcatctctacccaaa

SEQ ID NO: 313 - DNA, 258 bp, Homo sapiens
tggtgggccaggatccctgtccacttcctccctgactcagtccacctcctttcaggaggaatccctgacccctggttggcaacgtctcactgcacagcccatgcattccttaatttaacacttcagataactctacttatttctggtggaaagaatatggtcctgccctccaccttaggctgataccaggcaactgcaaaggaagcaatttggacttggattttctattcactggcttaagcacaggacttttactca

SEQ ID NO: 314 - DNA, 448 bp, Homo sapiens
tgaaccaggcgagaaaggatgacgatgttcttcatgttgcacctggacatgccccaggaacagagacttgcccaggtggcaacactggcacagatgttgacggctgcccaactggtgccacactgagcagggagccttgtgctgcacagggctgggccctctctccagtttccttcctgcaggcatccaaataccctggaagggatttaacccctgaattccagagggaagaaagaagaacagtgaagaagtagaactggtttctgtatggggagaggaaagtcttagggacagctgcaggcggggtctcaggctgctccttggcaccagctacacagtagtgagctttcccagctttaccgatgaggaagaagttcaaatagatagacttcagcattttaattattttcctataaatgtatttatgtgtagtatgctagcaccagcc

SEQ ID NO: 315 - DNA, 434 bp, Homo sapiens
gaggagaagggagcctggttacgaaaccgctcattaatgaagaaccaagttaacatggcagcactaggagcacacaggtgcaagagacgtcatggaagcaatgagttcggggaggtggaagaaaagttgtagaatttctggaaagctagagagcctcaggctccaaactattaaggcccttttcgagtttcctcttgttatccatgagttccagactggagttagtaatctgggcttattcatgccaacatgtcccataaagatacaaaaggagatacacacattcacaaatagacatatacacagatataaagatacacagatagactgataccaaggtacatcgactcatagatccaggtacaacgtataattggaaggatacctgtttgttattccagatctcaactgtgcttcgcaaagagcaagaaaat

SEQ ID NO: 316 - DNA, 459 bp, Homo sapiens
cttacatttccatccaaatccaatagaatgtgcaacagagagtacacatttgaaaaatattttcagcctattatgttaaataagaatttcatagttattcctgtctatattaaggttaaactgttacgttttgattagacaaagaaaatattgtttcaagaagatctttcatattctcttttatttattacagcacgagagggaaaattgtgttttgttttttgtttgtttgtttgtttgtttttgagaccgagtctcgctcttgttgcccaggctgaaatgcagtgatgcgatctcggctcactgcacctcctcctcccgggttcaagtgattctcctgcctcaggctcccaagtagctggggttacaagcaccctccaccatgccagttttttttgtttgtttgtttgttttgtatttttagtagagacggggtttcaccatgttggccagtctggt

SEQ ID NO: 317 - DNA, 176 bp, Homo sapiens
taaacaagcttctatgcctcaggctggcgttccacaaactcagccaaatcgtggggttttgtgaatgctgcagtcagcagggcccaagaaggcatatttgctcacacattatgtcgatgttttgttggtttttttttttttttttttggtcctaaggatactccttggactgtggg

SEQ ID NO: 318 - DNA, 389 bp, Homo sapiens
ccaaagtagtcacccagccatccaatctctgtttactcagccttgctgcaagactgtgcagtggctaagagtttagatctatactaataataaagtatcactatggggtatgtctgaaggcataagtagtcagagaggatgaagaggagaaaataaagcattcctctttctagacacatagtgcagaaattcctccaggaatgcaggaacatacagcaattagaatgcattcctgacatgttggtcttggcatgtgtgcagtaaagcatctccaaaagcatatattgtacggaaggcttatctaagacatccacagagtttgttcattcattcatggaacaagtaaatctactgaaagccttctacaggccaggctttgtgttgcatta

SEQ ID NO: 319 - DNA, 467 bp, Homo sapiens
ccccctaggtctgtctctaaaagttgatgatgacattgccaaggcaatcagtgactggaagcgtatgaggattacagtgaaactgaccagaacagacaggcccagattgagggggtaccttctgcctctgctctcatcatcaaagccctcgacaaactgccaaaaggcagaaagaaacagaaaaacattaaacacagcggaaataacacttttgttgttgagatggagtctcactctgtagcccaagctggagtgcagtgcggcaatctcagctcacagcaacctctgcctcccgggctcaagtgattctcgtgcctcagcctccctagtagctgggactacaggtgcgccccactgcgcctggctaatttcttttattttttaaagtatagatggggtttcaccatgttgcccaaggtggtcacgaactcctgagcctgagctcaggcaactgacccacctcggcc

SEQ ID NO: 320 - DNA, 742 bp, Homo sapiens
gcacatgcctgtgatcccagctacttgggaggctgaggcgggagagtcgcttgagcctgggaggcggaggttgcagtgagccgagatcgagccattgactccagcctgggcagcaagagcgaaactccatctcaaaaaaaaaagaaatttttttaatgctattttgctataggaaataaaaaatgagtttgggggatggatgtgaaaggtataggtttgtttaagataactccagcagcagggtggaaaataaatggaatgaattactagtggcaaaaactctcacctcacagtttctgtcaaaaagtcatgaatatctgaatttagacaaagagaagaataagattgaaagaggaaaccttagattttagaggtacatctcgtttggtggtgttaaagtaattgacatgtaaaccataccactttattttgcatttaaaagatttttattgatttgtcactgaggtagatatcacaaaatttttatactctgaacgtgcttcttaggtcatgaaaacattttactaatgaagcttaagtttagctaattataataataaatcatctcaaataaccaagactttaaaaagataggcacttaactattttttttaatttaagagaagttgtgaagtatgtagttcaaagttcataatggtaccttcacaatgtcttcagggacctaggctcctttttctcccttctatctcagcactaattatgcattcctaagattccctca

SEQ ID NO: 321 - DNA, 413 bp, Homo sapiens
ctaagctctttggagaggaaataagacttaatgtactggctagcttatagacacagttaaaataaactactgttcagaaagttttatttttccatttggttgaaacctttcagctctaaaatcttcctgagtttctataggaggaaaatcaagataccgtaacttatgtgtagaggtgtggaagaactgtcaatgtaattcattattgttttcatgtgttatttatgtaataatctgttctatgattatctgaggtggtttttctttctttcatttgtttttctctgttgcagatggctatagatagcctttcagattaaacatttccaaaatagaaactaaaattaatagaaaatagattatttgtgttaatgtaaaatttgtgataacggtaagagtgcaaaaaagagcat

SEQ ID NO: 322 - DNA, 307 bp, Homo sapiens
ttgttttgttttactaagaactttgtgttctggtcctgtccaaggtgcagatggttatgctttcaaaacaccttattgtcataatagcactcatttcaaataatactctactctcagtttcaccatttcaagcactattcatttgattcttgaggagaaggtgatgctcttccactgatcctccaggaagggtctgatcctccaggaaggctccatccacctcgttcctttcccaggttcataaggagggtggcagtgtcaaatgaaccctgtgccaggcactttcacattcagtaaggagagcatg

SEQ ID NO: 323 - DNA, 402 bp, Homo sapiens
gcagtaaagcattcaagaggtaacttgtgtgttcttaaaagtattcagtttcattcgttcacaaatatatggtttgaaattggaagttatgtttaaaagggaagcagagcataaaagtccaaaaaatttgcagcctgataatgcaataaaaaagaaaaactgggccaggcacgaaggctgacacctgtaatcccagcactttgggaggctgaggcaggcagatcacaaggtcaggagtttgagaccagcctggccaatatggtgaaaccccatctctcctaaaaatacaaaaattatctgggcctggtggcaggcacctgcagtcccagctactggggaggctgagggaggagaatagcttgaatccagcctgggcgacagagtgagactctgtctcaaaaa

SEQ ID NO: 324 - DNA, 359 bp, Homo sapiens
ctcaaatccaggtcaaagggttgtcagagcaatagtgggaacagaaaactagctggaggacacccgagtactcttaaagcaatccccgtggtgagtaggaaggggagctcagaagcatcagggtaacaatgggacaggtgtggggtctggttcatttcaccttggatctttttcacactgatgatgaggaggaacgagagtacagtgaagtaatagaagaggttacagagcatgtttatttgccagctaaagctaaagtggcaaaggagggagaggtgcatccctacccttctgcaccccctcattattattttgaagaaaaagaccctccagatctttcttttccagaggacactggg

SEQ ID NO: 325 - DNA, 335 bp, Homo sapiens
gattggctttgatggaactttgttccacaaggaatcttagataggactttctaaagccgatctagacgtggtcatgcctctaatcccagcactttgggagcccaagacaggcagatcacctgaggtcaggagttcaagaccagccagaccaacatggcaaaaccccatctctatggaaaatacaagaattagctgggcgtggtggcaggcacccataatcccggctacttgggaggctgaagcaggagaatcccttgagcctgggaggtggaggttgtgagccaagatcatgccactgcactcggcctgggcgacagagcgaaactctgtctgaa

SEQ ID NO: 326 - DNA, 195 bp, Homo sapiens
aggaaggaaggaaggggggtcgagagggagggagggagggaactgtacagaaagagagttcagaaatcagtggagactcacccttaaaaagagaattcagaaatcagtggagagtcacccttaaaatattgattggcaaacgcaattgagaaaccatccatggctaaagaaagaaccacctggtccctggtgcct

SEQ ID NO: 327 - DNA, 355 bp, Homo sapiens
ctgtcctccacttcctcactctttcttcccacttattttcactccactggtgcagtttggtgtcaactctcctcactctactgaaactgctgcagccgaggttactagttatttaattaacaaaagcaacagattttgtttttttaattgcattatactctactattttgtgacatttaaactattgacaatgtctttcttgaaaatgtgtcctttctgtttttttcaaaacacgactttctccttgatgtcctcctttttctctcattatttcacctttacattctctgctgacacctttcaccttaccaaaccttaattaaatgtgtatgcttcccagtctcccattcttggc

SEQ ID NO: 328 - DNA, 857 bp, Homo sapiens
tgataatggcaccgtgtctgtgactttatcgaataaaggggtgggccactctaattcatactaaaagaattaacttgtactgtgaatttttccatgtttgttggcatcttctttagaggtacaataaaataatttcatagtcataaattttataaaagctggatgtcctctgacatcaacttggggattctgaagtatttatatatggagtcatgtgaaatcagaatttctctgtgggaaggcatctctataattgtgaaagataataaaaaatgtatactttgtatattcttactcaaaaatgttaatatgtagagtttctaaagttaaattatcttctgttcatttttttaagaggtagggtctcactctgttacccaagctggaatgcggtggtgtgatcatagctcttgtagccttgaacgcctgagctcaaaagtttctcccacctcagcctcccaagtacctaggactactggcacatgccacctggctaatttttatttcattttatagagacagagtcttgctatgttgctcaggctgttcatgaactctcggcctcaagtgatcctctcacctcagccccccagggtgctgggattgcaggcatgaaccaccatacccagcccagattgcattcttaacgtaatgtcaaggcactctaatgcattattacattggatagaaacttcttaatgaaaattatgtgtgttgtgagtgtgtctacatgccactatttttctcctaaagcaaatcacagttgcttgcccaaaaaatgtgtgtgtttgtcttttttgtctgagagagattttttgccttttacctcataactaacttgaggtctgactgtaact

SEQ ID NO: 329 - DNA, 608 bp, Homo sapiens
gtccaatggtcgatctactttggaaaagtagtctggcgccgcttatccctagggtagcatgcctctttcatattccctatcaactctattccataccagcactcgattcgatcgggacatcccgatcttgcaccgcccagtcgtggttcgttggtccgatggcgccccgcagcctaatggccatgcatgttcgtcactctagcctgtgttcgattgttgcccgccaaagcaaaagaagatatatccacacgctggaagaccattcaacagtaaaaaggaatgaattactgacacatggcacaaaatgaacgaagctcaaaaaagaaagaaagaaagatgggcacaaaagcctacctatcggccgggcgcagtggctcacacctgtgatcccagaactttgggaggccgaggcgggcggactgcttgaggccaggagttcgagacaagccttgccgccatggcaaaaccctgtctctactaaaaatacaaaaattagctgagcgtggtggcaggtgcctgtaatctcagctactcgggaggctgaggcaggagaatcgcctgaacctgggaggtagaggttgcagtgagccgagataacgccattgcgc

SEQ ID NO: 330 - DNA, 476 bp, Homo sapiens
aaaaaacctttccctgtttgacctaccatgtgcctccatttctttatctgtaaaatgcggactataacagtacccacatcacaggactcttgtgaggattaaattagttaatatatatataaagcatttagaagagttcctgacacatcataagtactgtataaatgatgttgtgtgaggaaaggccaaggggaataaaaacagtctagaggttgggtgctgtagttcatgcctgtaatcccagcactttgggcagctgaggcaggtggatcacctgaggtcaggagtttgagatcagcctggccaataaggtgaaaccctgtctctactaaaaatataaaaattagctaggcatggtggcacacacctgtagtcccagctacgtgggagggtgaggcaaaagaatcacttgaacccaggaggcggaggttgcagtgagctgagattgcaccactgcactccagcctgggtgatgg

SEQ ID NO: 331 - DNA, 507 bp, Homo sapiens
ataactattttttttaaagggatctcactctgttgcccaggctaaagtgcagttgtgcgatcatagctcactgcaacctcgaacttctggggttaagcagtcctcctacctcagcctctcctgagtagctgggactacaagcatgcaccatcatgcctggctaatttttttatttttattttttgtagagacagggtctcacccccgagtttccaaatttaatgaaaactataaacctgcagattcatgatcaatgaaccctaagtgtaagaaatatgaagaaaattataccaagtcacatcataatcaaagtatttgaagccagtaataaaaaaatcttaaaagcagctggagataagacacattatgtatagaggaacaaaataattatggcagatttctcactggaaacagtgttagctagaagaaagtggggtaacatctttataaagtactgagagaaaaaaggcaaaatgaagaatttttcagacatagaaaaggtgaaag

SEQ ID NO: 332 - DNA, 363 bp, Homo sapiens
ctgcacttcggatcatataaaaagaaactaggagaaacaaagcaaagtgtaaccaagcatcattaggaattgaactcagtaattcccaagaacacaaagtagtagagaatgatggagatgttattttaaatatgaagaaaattataccaagtcacatcataatcaaagtatttgaagccagtaataaaaaaatcttaaaagcagctggagataagacacattatgtatagaggaacaaaataattatggcagatttctcactggaaacagtgttagctagaagaaagtggggtaacatctttataaagtactgagagaaaaaaggcaaaatgaagaatttttcagacatagaaaaggtgaaag

SEQ ID NO: 333 - DNA, 106 bp, Homo sapiens
caaatattcatagcagcaccatttataatagccagaaagtagaaacaactcaaatgtccatcagctgatgataaacaaaatgtggtctatccatacaagggaatat

SEQ ID NO: 334 - DNA, 454 bp, Homo sapiens
tgtatcatgagtcacactggtgtgtggttgtcctaatagattagtgttgtccatgtagttagcctgcgtatcctctatgaaattccccatcagcctttcacctaatggttaaggccattggtgattgttgcctagttccattatttcattaagaattacaaaatgggttgggtgcggtggctcatgcctgtaatcccagcactttgggagaccaaggcgggtcaatcacttgaggccaggagttcgagaccagcctggccagcatggtgaaaccccatctctactaaaaatacaaaaattagctggcagtggtggcacccacctgtagtcccagctacatagggaggctgaggcacaagaatggtttgaacctgggaggcagagtttgcagtgagctgagatcatgccactgcactccagcctgggcaatagagtgagattctatttccaaaaa

SEQ ID NO: 335 - DNA, 339 bp, Homo sapiens
aataagactaaatgagggttatcagggaaagacaatgtaatatctatatgttctgaaaatgcagatgtagcacaactttctacatatgagggagaaatggagatcatatacaacaatcattttaaattgtgttagtcatcataggtgatatggtgttgttattttgagactgttgcttgtgtaatatgagatgaaataaaacaatgctatgaagcattctaattttattatcccctgtgtcctgagaaccaaacgtttcaatgtgaaagacaggtatacagatgtaatagggaagaggttatgtaaaagctctgtaattttgattttgaattcaaagtg

SEQ ID NO: 336 - DNA, 461 bp, Homo sapiens
ctctacttctgtccacggcgcccacgtggtcatttccagcttcagctctgggactcagaaaggagttcctggcctttgagggaggggacctgagacataaaccagtaaagggaacaactccaatccatggagaggctccagcctctctcccctacccggggtcggctcccattgtcacttcctcatgtgcaaggcatctgggtttcccggttggggtccgaggcaggggccgggcctggctcactctcccctggaccctggtcccctttggccaccgaggggtcctgctcgctgctggctccggcgggagcgctgcagacccacagcccggtcctgcgcccacagaggctgctaccctgtgcagtgtttgcttccaacaggccccgccgccccgagccagcccccttctgtgccctaagccagtcgggctccaccacaggggtctggggccgggcggcctc

SEQ ID NO: 337 - DNA, 404 bp, Homo sapiens
cctgatttctcactctcagctgatgaccttgtttcctatttcactgggaaactagaagcaactataagagaaattccaaaagttcccatcaatacagttatctattacttgtgaagatgattctgtggtttttctcttcaactatgttattatggggacttatattaacagacttctttttttttttttttgagatggagtctttatctatcgcccaggctggagtgcagtggcatgatcttggctcactgcaacctctgcctctggggttcaagccaaaacttttgcctcagcctcccgagtagctcggattagaggcacctgtcaccacgcatggctaatttttgtatttttagtagagacaggatttcaccatattggccaggctggtcttgaactcctga

SEQ ID NO: 338 - DNA, 386 bp, Homo sapiens
ttttcatgagacggagtctcgctctgtcgccaggctggagtgcagtggcatgatctcagctcactgaaacctccgccacctgggttcaagcaattcccctgcctcagcctcccaagtagctgggattacaggtgtgcaccaccatgcccggctaatttttgtatctttagcagagatggggtttcgccatgttggccaggatggtctcaatctcctgactttgcgatccacccgcctcggcctcccaaagtgctaggattacaggcgtgagccaccactcctggccgagagtttgactttcatactttagaaattcagattcaattttatttgtaattttaccttatgtgtgaatgcataggaagaaatacagaaggtattataaa

SEQ ID NO: 339 - DNA, 671 bp, Homo sapiens
gccctttgagtagtaaaattttagctcactcagaaaaacctcatagtttatttggagtaacatccctttagcccttgtagatattataagactacattacaataaagttctggtgagtctaattgttgaccagagagattgtttacttcagagcacctggatttgaattgcagtgtgccacctgctgctgtgttacctggtacaagttaatgcattctcttcacacctcagttttatcatcttctgaatgaggctaatagtagtacctgtcatagatgcttgtaacagtgcctgcatagagtaagaatgaaataatgttagctattttttattgttacatttaaaatagattttgctggtagtgaaatatgaatgataaaatcatctcctcagctgttttccttgcataagtaccttaaaataatgtatttgcaatttccttctgaatccttgaataaaagacaccagataatcagaagatgttactgacattagtaggcatttgaagttcactctgatgggatcagtctatttacaacaaattgctatagagagtaaaaagcgccaaccttttcctgtagtttttgaatgacagcatctttgttcatgcagttggctttgctgcatttccacttcatcaattttttggctctgtctttgcaaaaaaaaaa

SEQ ID NO: 340 - DNA, 406 bp, Homo sapiens
gccctgctgagctcaggaccctgtgtgactgcacaggccacacatccatgaagctggccttgtccttcgggtccttcgttcccccacccacccatctccttcagcacacacagacctctgctctccacacaaccctccctccaagaggaagtgagttccctcatttttgtcacacttgctcctctctgtgctgcctgtgggaacaagaacacttcacacagacacctgagtggggtctcgccccattcccactccctccccctgcccacctactcaggagttcaaccagatgagatggctggaaaccacagtggtatccctcaggcctcaaaactgttgtcttcctggaaccaacacttactgaatcgtataacaatatagagtcccaaaactcagattaagcaaa

SEQ ID NO: 341 - DNA, 338 bp, Homo sapiens
ggcagccacaaaggccacccatatatagtaggattccatttatataagatctccagaatgggagatcagtaaagacagaaaggagattagtggttccctgggtggggtgggggagaagtgggggatgatagctaaagggtataggattttctttttgggataatgaaaatggtccaaaattagattatggtgatggccataccactctgtgaatataccaaaatccattgaattgcacatcttaaatgagtgaattattattattattattggagatggagtttcactctcgctgcccaggctggaacgcaatggcgcggtctcagctcatcacaacc

SEQ ID NO: 342 - DNA, 450 bp, Homo sapiens
gaaatgacattgagggagattcatacactggcatttagacgccattttaaggacaagctttatttggcttctctttggaattccagagtctctacccagtgtaaagactgtgtttaatgcctgaatgcatttgctagtgaaggtgatttcccaagatttctataataaaagtggggagaagtattaagaaatacaatcttgagccaggcacagtggctcatgcttgtaaccccagcactttgggaggccgaggtgggtggatcatctgaggtcaggagttcgagaccagcctggccaacatggtgaaaccctgtctataccaaaaatacaaaaaattagcctggcatggtggtgggcacctgaattccagctacttgggaggctgaggcaagaatattgcttgaacccaagaggtggaggttgtagtgagctgagatcgcaccattgcac

SEQ ID NO: 343 - DNA, 711 bp, Homo sapiens
tttccactttctttaattccttatcagcacgcggaagtctgcagctgtcaaaggtgaagttcaagtgacgttttggtacaaactgccatccaccaccaatccaactgaccatacatccttctggggagtactaatccagtacgcactccctgctataacagggacagtgacaggcagaattgtaacatcaacagctctttctcttggagagaacctctgggtcagaggtaatggaaccctgtattattttgagagcccattgagcccagacaagctgactctgtggaagtgtggttttaatgtgtatgtatggctttagcagaaggtaacttggattctggtccgagggtgtggattccaatcacttaactccagcctgggttgagtcagcaatccagagaaagggcttcagtcaaacaattcttaggagatccagtactgtccaactaaccttcatatattctctcgactctagtacatggatatgcttgacatttttaaagaacaggaggtgggcagacacttcctgttttacaaggcgaagcatcccactatccttgtaagcaagatcagtctgtccagcagaattttgcatctcatcccttcccttaccttctcataaacctcatgcatcagccatctcctctctcccctatcttcaacattctctttctcctaactcttccccatcagcatatgcacactcccaag

SEQ ID NO: 344 - DNA, 1599 bp, Homo sapiens
aagatatcccccatggcagagaaaaaaaaaagtttcttctgggatgcagacaatccaggaatcagtgataatccactgacctttctaggaagtaagagcaaagaacaaacaggttagattctgagaagctgtttctaagtttgatggttttttttttcctaagcctgaggcactgagaagggttcaagcttgtattctccagatgcaagatttactgttacagcacactgaagtcctgagccctccgccacccgcaaggccttcctcggagacagggacctatccagagatgtctctgtcactgtcaggatgcgctgcaagtggacaaagggtttccttcgtgttgaccctaagaagacctcgacttgatcaaggaagaactgagcatggcttgcagtagagacagtcacacacagcttcccatgaataggtgtgggcctgatcatcttagcaccttctctagccttcaagaagctctcaaaatcagggccatcttggtatttcactagctgcttctttctttttttgatattttaagagacagggacttgctatgttgcccaggttggacttgtattcctgggctcaagccattatcctgccccagggctcccaagtagctgggactacaggcctgtgccacctcacccaccctcgctgtttatttcaatgaactgcaggttgatgatgatcaatcttctttcctaatctcctggttgaaattagggatattcagatttttttgaagtggagactatcagggtgttagaagacctagttctgaacctgctctctgctaacttaccatacgactttaggcaagttgctgccccactaagaacttcagtcttatctgtgaaatcaagggactggactaagtggtctccgagatcccctccagctgaaaccatctcctgtactgtccactattatagcaaataaccacacatggctgattaaatctaaattaatgaaataaaagtcagaatgtagttcctcaatctcactaatcatatgtcaagggctttaatagccatgtgtggccagtggctgccaggttgaacagtgtagttctcctgctctcattttattgatgatcatggtttcataacaaaacctgccagttgaagaccactttcacgtgtatggtgcattttaatacacgcttacatttaactacccaaaataggcaagagagatattctaatatctgccttatcagatgaggacactaactcaaagagtaaattacttgctatagggtcataccactaatgactaaatgtagtttccaagcccaggactctctaacacatggtacaaagtcatgacgagaagacatgtgccccctggccaaaactattcaacccatggtagcaccagaactgagatccagggattaagggctgatctggagaccctgtgccttggtgtagaccttagctcagcacatcctagctgtgtgaccatgggcaagttatttaatatctctgggctcctttctagtcctctgttaaatgggaatgaccacaggatccactgcttatgagaactgcacaagtagatgcaaataaaatgctttgcatgggaggtcaggca

SEQ ID NO: 345 - DNA, 1037 bp, Homo sapiens
aagatatcccccatggcagagaaaaaaaaaagtttcttctgggatgcagacaatccaggaatcagtgataatccactgacctttctaggaagtaagagcaaagaacaaacaggttagattctgagaagctgtttctaagtttgatggttttttttttcctaagcctgaggcactgagaagggttcaagcttgtattctccagatgcaagatttactgttacagcacactgaagtcctgagccctccgccacccgcaaggccttcctcggagacagggacctatccagagatgtctctgtcactgtcaggatgcgctgcaagtggacaaagggtttccttcgtgttgaccctaagaagacctcgacttgatcaaggaagaactgagcatggcttgcagtagagacagtcacacacagcttcccatgaataggtgtgggcctgatcatcttagcaccttctctagccttcaagaagctctcaaaatcagggccatcttggtatttcactagctgcttctttctttttttgatattttaagagacagggacttgctatgttgcccaggttggacttgtattcctgggctcaagccattatcctgccccagggctcccaagtagctgggactacaggcctgtgccacctcacccaccctcgctgtttatttcaatgaactgcaggttgatgatgatcaatcttctttcctaatctcctggttgaaattagggatattcagatttttttgaagtggagactatcagggtgttagaagacctagttctgaacctgctctctgctaacttaccatacgactttaggcaagttgctgccccactaagaacttcagtcttatctgtgaaatcaagggactggactaagtggtctccgagatcccctccagctgaaaccatctcctgtactgtccactattatagcaaataaccacacatggctgattaaatctaaattaatgaaataaagccggatccgggccgaaccccccttccctatcgacccaccaccccgcgaccccctcc

SEQ ID NO: 346 - DNA, 379 bp, Homo sapiens
ggcatttcaaagctgacagctccagctgtccagccttcctccctccaatgactcatacccaacagatggtgcaaatagcttggcatcaattcactgaatcagtgttgggggaaaagccttgccagacgactgatggtttctttgaagttgttcattctggcaacaatgcacagctaatagaacagccttggctgaacaaaaagatatgaaactgatgtttgagagaaaatctggaacataggggtctatatctgtcacagtgcttgcaattattttctaccaataatatcatttttattattattatctaccagagctatgtaattctctcacttgacattcctaatacttgatattaaaataagcctattaatcctgc

SEQ ID NO: 347 - DNA, 722 bp, Homo sapiens
atgcccaactgatgtttttgtatttttagtagagatggggtttcaccatgttggccagactggtctcgaactcctgacctcaggtgatccactgcctcagcctcccaaagtgctgggattacaggcgtgatcctaagtacagttttataggacaaccatgctcattcatttccgtatcgtccacggctgctctacagcagcagagtttagtggtcaggacagaaccggcacaacctgcacaacctgcacaactttcaaaggctgaatatttactctccggctctttagagaaagtttgcaactcctactttagactgatgcttctccaatgctaacgcgccagtcaccaaatcaccggcatctggtcccagcctccaaccataaaccacagctgaatggaaacttggtagcgcttgccttcaatagcagatgctgtaagaggaaagcaaggtgaccaagaaaacattgcaaaactctgggcagaatctggggcctgaagactctgagtcagaggcctctttttttgctctaaacacatattagcaagagtccaagaggcatcaaagatgagttagcagcaaaatgaggctttgtccttcatgtagaaaggattaaatgatagttgaaaatgcaataactttcaccctgtgggattcagtgatgttcagtgctgtgattatgtccaacttcaaatcttgctgtcccaactgggacagcccaaa

SEQ ID NO: 348 - DNA, 829 bp, Homo sapiens
gcagctgcttgtcctactacttttagctgtgggtgcatcctttctgcgtcctgctaaaaattatattcttgttttcacttttaaaacctaagacggttccagagctgtgtttggtttttgctttaaactaatgcccgagcgcccctttagttagtcaccaatcactgtttaggtaagttgatgattcctttttgctacccaagatttttttatttaaaattgagcatttttaacttgctttttaggtcagaggatcaatgtcctctgtggtattcctcctccatctaagcttcttaaagcagtattataaatagaggctttcaacctaaaaagtactgtgtatttcattgactagaactgaactgaactgtaggctaataaaaagtaccaaatgaaaatattatggtatctcattgcactccattgtagatgtaatgtagtgtgaccagcagtagctttgattcattgtaaatcccatctgaatactgacaacagttcaaaacatcaggagataaacctcaaaggtcacatttgtgtgaatggtcattgtgcatataagacatcattttattatttgaaaactagtagtgtagctcttaagacagggcagtgtcctaacctctgacagggatagaggcgagaggagaatcagtgggctgccaaacagtcatgtgttcataggtgaggttctgtttcttctttagctgttactattgttattattattattattattatttgcatgaatggtagcagttacttcacaggcaaatttcctatgaatcccagagtattgcaacagattagcagcaaataaagacctgagata

SEQ ID NO: 349 - DNA, 441 bp, Homo sapiens
aaccattataaatacaaaattcaataattttagtaaatttatgtaactgtgcaaccattctaaaatccagttttgaacatttccgtcactccaaaagtgccatcattctttattacagttaatccaagtccaaaccctagtcctaggcaacaactgatctgctttctttataaatttgccctttctctacagcttataaaaatgaaattccacaatatataatcttttgtatctgccttctttcacagagcataatgtttttgagagtactccatattgaagtgtataaatgtagttcatgccctatgccctttaacttcaggatattatttctttctttctttctttctttctttatttgagacagagtcttactctgtcacccaggctggagtgcagtggcgtgatctcagctcactgcaaccttcgcccccccaggtt

SEQ ID NO: 350 - DNA, 405 bp, Homo sapiens
gggggccctacctttgctgggtcaggaaggggaggtcaggccaacatctagattctgacagaatcttcctgcatgacgggaatttcaacatctattcaacaacacaaaagtcagtgccactgtgaacatcagactgaagtctgagatcttcccggagaccagctggccaaaagatgtcattgatgcctagctctgggcaggcagaagagacccggagcctgttacaaacgccttctccttcttcttggagttggttctggctttcataattcacagtggatccagagttgcagagataattcttagtcttgggccattctggatatatcattcttcctcatagaccattctggatacgtctttgtggccaaaaaagagttaaatagctgcaaggttgttgatttg

SEQ ID NO: 351 - DNA, 387 bp, Homo sapiens
gcgtccttccgctgcaccatgaacccccaggcaggggcagcctctttttatttgggtgtaataaagatctgattgggtctccttggtcagcctttgttctcacctgccttctatcttgagagcagagtgtagcacttccatggttcctacccagttcaacttcagaagcctttggggaagggtgtctgtttttctgaagacatggcgagggagacagaggtgcataacgtcttcaaaattctaccttaggcatcttttgattctcttccccaaagttctcctcttttgccagctgtcttatctttttttcacccttctctatttccatagcctctttaagacttccagcattccagtgcccccctcagcttgtacacccactgagca

SEQ ID NO: 352 - DNA, 332 bp, Homo sapiens
cggagttttgcctgcttgttacattagtgaatgtaggaccacttgagtaaaggaccaaacctttattcttttgcttttctgccattgaaaccattcaacccatgctgattaatacctactgtttgccaggtaatatgccccttgcagaaagacgcaaacagctaaaccccaaatgggatgttgtacaggacaaatgaccgtgtcaattaataccaataattaagataatagtataattatgatgataatataattaattcgagcctggaggaaacaaaagaaagtggaactgaactattagagaataaatgagcttaaaagacgtcattgaa

SEQ ID NO: 353 - DNA, 1217 bp, Homo sapiens
tagtggcttaaaatctagaagtttatttcactcttacagtaatattcacatgtaagcaatcaagtcagccatgaatcaagctactttctacttccttctctatcgtggccatcatagatctcaccctcatgatccaacatgaacctccagccatcacattggctaattgcaaacagcagtgtagatgatgcagcaatacacttcgggaactctgtagaaaatttctcaggaggaattgttatgtaatagttctactttcatccttttagtcacatgccactactcaatgcaaagatgagaaatgtatctttcatttcagttggccatgacatcaattagaaattagtggtgttgtttggaggaaaattccatagggaagacagctggcagtctctgcatagatttcttcattgttctttaaatccgccgtattatacaatcattttaacaattaatgaaataaccttgatattaggaggctgtaaaaggaacttgacccacctgactttgtgctttttgaaatgtatttctattttataacttttatccatcaccgcgccctgtttcttgtgatatttcatgggtctgacctcaaacataaggataatattaatcaaatgatcttgattattcagttggcaaatattaaaggcagatgtaacatagattgaaaaaaatgaatttttatatgaacaaatggagactgagttatttaactagatctttgctgatgtgatgtaaaacaaagaaaacagagataaaaacaatgtttaatatacaatttaattattctttaaccagcaagaaataaaaattaacttctcaatatgtaagtgcaaattgacaattttctgtggttctttagaatatatatgtatgttataaacagtgagattattggcagatagaacttaactttctcttgagttaagcatttattgcatatgcaatctgtgacaaatgctataataggtagcagagctcataaggaccaacatatacatgtgcctgccttttaccatcatttttacatgtggttcaaggtacgctttttgattctatgtccccaacatgctgcctccaaacagtttcttaaaaagttctgttactattaaattgcatgaaatcttagaacttcatatagtgcttccatgagggaatccctctcttgcattaacgaggaaactaatcttcttccaaatcttcaatcctgaaaa

SEQ ID NO: 354 - DNA, 329 bp, Homo sapiens
gacatgagatttgggaggggccaggggggaatgatatggtttggctgtgtccccacccaaatctcatcttgaattcccacgtgttatgggaggaacctggagtgaggtaattgaatcatgggggtgggtctttcccatgctgttcttatgatagtgagtaagtctcacaagatctgatggttttaaaaatgggagtttccctgcacaagctctcttctcttgtttgctgtcatgtgagacatgccttttgccttccaccatgactgtggtggcatgtggcactgtaagcctaataaacttctttcttttgtaaattgcccagtctcagg

SEQ ID NO: 355 - DNA, 424 bp, Homo sapiens
tctgttacccacaagcacttggttttggggcttcgctccttatgtttctctttctttgcttggaaacttccgatccccaggaccctgcaaactgcatctcgtaatttgccctccacggcacgggacgagcagccacagctgctctgggcctccctcctcgggtccttgatttccccagaaattcccagggaacctctccgccccacagctcgtgtcagaggactctgagacttcactcttcaggaacccttttccagccgttatttttgttttctttaccggcctttcacctccacccccaccaagacgtacccttttctccgcaacacaggactgttctctgcccttacagagcctgttttaattccgagacttttctcctgtctttcttattttgagagtcaaggagtaacaggggctttct

SEQ ID NO: 356 - DNA, 340 bp, Homo sapiens
ctggcttggggctggtgtgggcagtggctcccagctgtgagccctagctgtgaattgatgtgagaatccagtgagatagaggggtggggatgccttgcaggggctccacagaccagccaatgatgctggcctagagaccaccctccacggagaaaggggagcaagattaacacaaagaggccaggcgtggtggctcacgcctgtcatcccagcactttgggaagccaaggtgggaagattccttgagcaggagttcaggatcagcctgagcaacacagtgagatgtcatctctaccaacaataataataatttttacattagcccagtgcagtggcacgt

SEQ ID NO: 357 - DNA, 355 bp, Homo sapiens
taagcattgttcttgaaggtagttcacttgctttatatcaccttagttttgttggaggcataattgtatgccttgttagtgcaggtctactatggttttatctttactcctaaagtgaatatcttagttttgggaggtggtctttgcttctaaaatgttgtctttctaaattatagatgacctgaacaaatggaaacacatcccatgctctttgatgggtagaatcaatgtgaaaatgaccatattgccaaaagcaatctacaaattcaatgcaattcccatcaaaataccaccgtaattcttcacagaactagaaaaaccaatcctaaaattcatatggaacccaaaaacagcc

SEQ ID NO: 358 - DNA, 356 bp, Homo sapiens
tagttcaggttaattattggcaatctgtagatgtgcagcataggagcttctcttcccctcggcctgggcctctggaggtttcttttatgagctctgaaccctgagggaggacttaaagtaatgaattttcctgtaatcagatttgagggtttgttccctgagccatccagtcaattggagaattgagcactgactggtttatttggctacgggatgcaggagatgatgcacagagcatctgataagcaacccggggaggagagtgaagaaatggcatgacatattcaagaagttgacctctgggcttggagggagcggttctgtttacaagggggacatagtgtctgggagctatt

SEQ ID NO: 359 - DNA, 505 bp, Homo sapiens
gtgtatgcagtgatcactctcagctagcaaacttagagaaggctggcaatagtgacaagtgtagtttccatttactaattgattactatgtgccaggcatggctgcagagctttttatgctatcttatccaattctcataataaccctatgaggcaggtcctacttattagtcccatctgacagttgatgaaacatggcacaaacttatagcctaagacaggggtgagcaaactgtggccgttgggtcaaacgagactctaaagaggtactggcatgtccaggccccattattcacagtgtacatggctgcttttgagcttcagtggcagagttcatcagttgtgaccaagaccttaggccccataaggccaaaactatttactatctggccctgcctagaaaaagctcaccaacccctagtgtaaaacacagttgattcatgaataaagaaaaaaggcaagaacacgtggacagcttcacatagaacttacattgaaatttctt

SEQ ID NO: 360 - DNA, 346 bp, Homo sapiens
tcatcgtaaattaacattgcctgctcatgaacttcatctaaatgaaatcatgcagtatgtatttttttatatgtactcagcaatagcaaaggaagaactactttcaacaaaaaggttgactctcagaaacatcatattgagcgaaacaaactggaatccatttgagagtgaggttcactattgacatgagtgggacagcaggcaaaaaaggggggctgttctggggaatcaagatgaatgttcaccttatctttagaatataaaaacctcaagcctgtaccatacaaaagtacagtgtctggaaaaccctctcatgcaataaggctttgttctttaatagacaact

SEQ ID NO: 361 - DNA, 322 bp, Homo sapiens
gcaaagtttaggcttccagcctgacttcagttgatggattgtcaaaagaagggatctattatccctttattcttggaaccaccagtccctgccccaaacccttaaacccctagagagcactgcctcgtcctctagcctggggctcacacaacagtctgccactcaggctgctaggagattctccaatagcaggctcagcacctcaaactgcccaccacctctcctactgctcctctcccacccaccacccaaactcctcagtcctgtcatgtagcagagttccagtaactcaggaaaatggagaccaaggtcattccttaag

SEQ ID NO: 362 - DNA, 300 bp, Homo sapiens
tgttgaatcagcagaggatgtaaccacttagatagcactatgtgactcaaataaatgacagattgagtctttcaagtgtcacagtatataataaggatcacaaattttgtgtgtgtgtttttttattaagagaaaaaaaatggctttggagtcaagtacacttagtcttaaatcccggctccactgtttgctagcgatgtaactgggtgtattacctcatctgtacaatggggataataccaccaatctcatggttaaataaagtagtgtgtgtaattgctcagcatagtagcatagtac

SEQ ID NO: 363 - DNA, 201 bp, Homo sapiens
gaaaccctgtaccctttagctatcatccctctattcccaaccctttccccagcccgcggcagtcattgtgttttacaaggtgattcttggctgggcacggtggcccatgcctgtaatcccagtactttgtggggccaaggtgcgcagatcacttgaggtcaggagttggagaccagcctggccaacatagtgaaaccctgt

SEQ ID NO: 364 - DNA, 423 bp, Homo sapiens
cagagtaaattatcaaggcagtaagaggatgaaacttcagcctggggaaatggttaattgctttgccctctagttattattttggtcctagcttactgtagagtatagcatttcaagcaaagggctataaatttcatggtaaggggcatctattcaggggtgcagtggagatgggaaacgcaagcagtcattgataccaaccttgatcatcaatcatggaaaatgagtgtctttttcaggcaatgctgtctaataccccttgcattttggtttttcctgtgttttcgactccccccattcacataaacctatatgtacccaacaataaaatatacacacatgtggactcaatcagcaatgccttaggctggccgtggttttagatacctttgtgcatacaggatccttagtcaaggacaatac

SEQ ID NO: 365 - DNA, 255 bp, Homo sapiens
ttcagggcctaaagtcacaaaacggcagcctccagccaggtctggctcagcccacagagctgctggggtcagagcagctttaaaacactacgtgcagggcttggaaggccagcagagcacgggacatccctgtgtttcatgacctccccctccccatttattccagtcacctgcctggccctgtgtcctccatgtgacccaggccaggggtctccaaaatggcttactttgcaggaaaagacaaatgtgtacact

SEQ ID NO: 366 - DNA, 401 bp, Homo sapiens
agaaagcatgctgtttctggcctttcaagagctccccaagtaccagggaaccagggctctgctacaaatactaatatctaatgtaatagagtgagacttccactactgagcacaatgagggtgagggactgggtttaccctcctgcctgagacaaccaaagcaaaccaaaaaacaaaacagacaaaacccagagtcctcaagacactggacatgagcaatgaaggacagtgatccctgggagacgagagactaagtcagccctatggctgccccaactcgctgctttgagagagttcctaggctgtggcacaaggaggagggacaggcaaccctctgaattgaagaggtgctgagaatctaaggagaccaagacagccacagttcataagacagagcacca

SEQ ID NO: 367 - DNA, 481 bp, Homo sapiens
acccaaaatctggtcataaaaatggaagttaaattaaattgtcctcaaaatttaagtttgctacatttgtaagtgccacttgcttcttcaaaatttcaaactttctcatatctagcagcaaatcaaaattaggaatttaagcatgtaaattcatcgtggaaaccaaatggattaaaattttctgtgtattcatgataatgtttaaaatttttgctacatttaaaccctaagttagttacaaaaactctaaaattatgcttgtttaaaaacttgggctaacttgcttttgaaaacatactgacatattcattccattcttcttataattatttttgtgtcactcccaaacagcacaccattgtatatgtccccaaaatggcacttctttgttaaagccattaagacagaaatatttttgagccagatgcaatggctcatgcctgtaatctcagtacttagggaggcctaggttagaggactg

SEQ ID NO: 368 - DNA, 405 bp, Homo sapiens
cctttgaaggtacgatccgagaagtaaatgccacagagacaacacacagaactgctgcaggccaagcctcaccacttcttaaaagtccgagcttagtttctcattcagcccactgcagtctcctgaccaagccacacacaaacagtaaaacctcctccctctgtttctcaggaccctcacttgatttcaggctcattctggacagatggggaaatgactacttgcaaagcaggattccttacattgcaacttttcccaacagctccgtgctccttcaatatgcccagaactggaggggaacattcttctctttcccagaagattgaaaaacttgaccacagaacccatgggagggacaactgtccagcaccagagcttcctgcccagttgttgcctggcaccgct

SEQ ID NO: 369 - DNA, 340 bp, Homo sapiens
agtcagcaaatctaaagatggacaagagctctttaatggccaggcatggtggctcacgcctgtaatcccaacactttgggaggctgaggtgggtggatcacttgaggccaggagtttgagaccagcctagccaacatggcaaaaccccatttctaccaaaacaaaacgaaaacgaaacaattcaacgggcatggtggcagacacccgtaatcctagctactcgggaggctgaggcacgagaatcccaagaacccaggaagtagaagttgcaatgaaccacgatcatgccactgtacaacagagcaagactgtctcaaaaaaataataaaataatattttt

SEQ ID NO: 370 - DNA, 336 bp, Homo sapiens
ctgcttttacattttatcatccaatcctttcatttcaattataatctccctttttgttggttactgagaagagtcatttttgttctctatgagatttctgtgataaataactgttgttctcagccaaggctcctcctccaccatctcctcgttcttctcttcctcctcctctttttctttgtctcacctctactctccctggctgctaggtcagggcctcagcaaaataggaagaaagtataagagaatcaggagcaaagtcaaatcaagagaaaattgaaaggagtccaaatacagaaagacagagaatagaacatggttaccatggtccggtag

SEQ ID NO: 371 - DNA, 321 bp, Homo sapiens
gctcaggctcctcctctgggctcacagtgccctgcgcttcccccatcccagccctgtccatgctaggtcctcactgtcgcctcactgactatgagttctgtgaggaggggcctaggctgggcccaggtcactgctgtgtctccagctttgcctagaatagagctgggcacagaggaggggtcagaaaacatttagattggctgggcaggagggctcatgcctgtaatcccagcactttgggaggccaaggcaggaggatcacctgaggtcagcagttcgagaccagcctgggcaacatggtgaaaccccatctctactaaa

SEQ ID NO: 372 - DNA, 432 bp, Homo sapiens
aaacctctgcacacttgactctaattgattgcaattctaccctgatttcccttttgtctaagattggggaataactgagtaaaagcaccacctctgtggtcttttcctcccattaggcccagggaaactttctatacacaaaatacatcgtctgttttggtctttacaatttagaaactacttttaccacatactatatatataatccttctaatggccctttcattagggattaccttatctattttatggaggagtaaactaggactgagaggtcaaggttctttccaattcatactcagaaagtgtcagggtcagcttacaaactgagccaaaaagtctgtgttttttcattgtattacattgctctttgtccccccatgctggttcctgggttaggggctgaactctgaaacggccttatttgtacta

SEQ ID NO: 373 - DNA, 1719 bp, Homo sapiens
caaagccccaaatccctagagtgctttctggtctcactttggtaccaaggaagcctcacatagtggtactgcatagtcccactataagtcaagttgcagtttaaggtggtctcagccaattgttacaagctacagaatatatacatgcatctatgtacagagccttgcagagaaacacaaaattttgaggctagacccatgatcaccaccaactataattgcacaaggtcttgttatattgatctctcctcgaactcaactaacgatatcttgaaaacaaagacccttcggtgtccatctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtctataccttcctatccattggcaagttaacctccatctggttgatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaagatacctggggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgccactgtagcgcctttttaaaataaataaaataaaataaagcaccattttgtttccctttcatgaagtacactgtatttccgtcttccacaggggtgggagctgctattgctctagcccctgaaatcaaactca

SEQ ID NO: 374 - DNA, 1687 bp, Homo sapiens
caaagccccaaatccctagagtgctttctggtctcactttggtaccaaggaagcctcacatagtggtactgcatagtcccactataagtcaagttgcagtttaaggtggtctcagccaattgttacaagctacagaatatatacatgcatctatgtacagagccttgcagagaaacacaaaattttgaggctagacccatgatcaccaccaactataattgcacaaggtcttgttatattgatctctcctcgaactcaactaacgatatcttgaaaacaaagacccttcggtgtccatctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtctataccttcctatccattggcaagttaacctccatctggttgatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaaaaaggggagatttcagaagacgggcgaaacaactgatgggggaagatacctggggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgccactgtagcgcctttttaaaataatctactcactctaagcccccacaaactttctcttctctcacaatccttggcctcctttctatctccttgcttggaaa

SEQ ID NO: 375 - DNA, 1665 bp, Homo sapiens
caaagccccaaatccctagagtgctttctggtctcactttggtaccaaggaagcctcacatagtggtactgcatagtcccactataagtcaagttgcagtttaaggtggtctcagccaattgttacaagctacagaatatatacatgcatctatgtacagagccttgcagagaaacacaaaattttgaggctagacccatgatcaccaccaactataattgcacaaggtcttgttatattgatctctcctcgaactcaactaacgatatcttgaaaacaaagacccttcggtgtccatctacagtaaaccccaccattaccttctagttggcataaaaacaagaaccacaaaaacttgaaaaatctgaaacagagaacagaaggccaagagccagcttctgcgttctcaactttattcaacattagacttaccttatttctttcagtgtgtagggacaagatgtactgctgtgtgtgtgtgtgtgtgtgtgtgtgtgtgtgtgtgtgtgtgtgtgtctataccttcctatccattggcaagttaacctccatctggttgatttggccatgctatgctttcttcccattcccctgctgtctattctaagcccccagactcaagcctctagactcttggatgaaacagtgagaagaaaacattttctgacttacccttttggaatctcctccattattacccaggctttgctttaagttgcactttaaatcacactgtcctattaatgcgatctggcatcttctcccacaagccccctacagggaacaactaccccctaccttaactctaaatggttctttagactatagtctgtctcctctgacctgaaatcctcttttaggcaataggccgagctttagaagcagccaggtctggtgagaaatgggcccccataccaactgtggacttggaatatcagcagagtagtaggcacagttgtaaaaaggggagatttcggtaggcacaggtgtaggtgagaagatgagaaagaaatgatgctgagggacctagtgaaatcaatgaaactcttgagtcttgcttaggctcgcaaacaagaagtggggaggcttgggaaattaggatatgacatatatgaaaggtttatctaagaagaaagaaacagagataatatatatatagaaagatgtatatagatgtatatatgcccaaatatattgaatgtacagaaaggaaatattcagagactttagcattgggggcagatatcttggcctggttatggggtaggacacccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgccactgtagcgcctttttaaaataaataaaataaaataaagcaccattttgtttccctttcatgaagtacactgtatttccgtcttccacaggggtgggagctgctattgctctagcccctgaaatcaaactca

SEQ ID NO: 376 - DNA, 1533 bp, Homo sapiens
ggcgctgcggagggagggggcggcccggcccggcccagctctgcccccggccggcccgaccccggccccggcccccggacaagcccttatctgatcccagctccgggtttaagagtcctggcccggcccgtcgcacagctctgctcctaactcctgcccgccccgtccgtccatctgtcccgctgccccgcggcccatccaaggggccactccacctcggacccaagatgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccaggcagcccagagaagatctgtttccctgtgtcctgtgaatggaaggacccaagccaatatgttcctttgaaaagagtccagtacccaggccccatggaaaggtctgaaaataatattccagattacactgtacctggcttctcttcttcctttcctgctcagcctagatccttcttccttaaccccaactctttgggagaagggagggaaaatgcaagggccttcctctcttaacacggatgctcaagtaaaactagattcacagggcacagattccccagaaagttaacacaatcccaccatgagggatgggtaaattctcagatttccaaactgctgtacagagcctctgagaattggtgatgctttgttaaggtttgggcaggagcagaactctgtggctggcagccactattctcagttacacctcccagtgcccttctgaaaagtgccagctatttcattaggcaatgctggaaggaaatgaaattataccttctgatcaaataaccatggcttccctcagccattcctgagacttggtataaaatgaagaaatcagtgtcatctctactctcctctgccatgaggccattttcagacaagtt

SEQ ID NO: 377 - DNA, 479 bp, Homo sapiens
  misc_feature (75)..(75): n is a, c, g, or t
gaaaggaaatttcagagcttagcatgggcaattctgcctgtagggggggggggggggttttaaaaaggggggggnaaaccccaaccccagattttcagacttacaatcagtggtcctggtttcaacatggaagtgagatagctgatgaaggatttcaagtctggaaatgggaaagggaggggtagaagttccttttcagaaataaagaggcattcatgaaggcttttgttgaatcctatgctactgataggaccaggaagagaggaactcggaggacaatagggaggggaagtcttggaaaatctaccacttacactgtgtgtccccatccccagcagcgtcctgccactgtagcgcctttttaaaataaataaaataaaataaagcaccattttgtttccctttcatgaagtacactgtatttccgtcttccacaggggtgggagctgctattgctctagcccctgaaatcaaactca

SEQ ID NO: 378 - DNA, 2765 bp, Homo sapiens
ggcgctgcggagggagggggcggcccggcccggcccagctctgcccccggccggcccgaccccggccccggcccccggacaagcccttatctgatcccagctccgggtttaagagtcctggcccggcccgtcgcacagctctgctcctaactcctgcccgccccgtccgtccatctgtcccgctgccccgcggcccatccaaggggccactccacctcggacccaagatgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccaggtcaatgtgactttccaagtagacacagcctctgacagccccttccttattctaccccttaccttctatcatgtggtagatgagaccagtcccttgaaagatctccctcttcgcagtggtgagggtgactttgagctggtgctgatcctaagtgggacagtggagtccaccagtgccacctgtcaggtgcgcacttcctacctgccagaggagatcctttggggctacgagttcacacctgccatctcactgtcagccagtggtaaatacatagctgactttagcctttttgaccaagttgtgaaagtggcctctcctagtggcctccgtgacagcactgtacgctacggagaccctgaaaagctcaagttggaggagtcattaagggagcaagctgagaaggagggcagtgcccttagtgtgcgcatcagcaatgtctgatgacctgttcccactcccccattcctctggtctcttttcctctcttccaatgccctggtaaggaatactacccgggtttactggagatcccccgaagcacccatcctccactccctcttctttaacccagtggcctgttggtagcttaggccaactggagtccaggttcgcctcccactgtcccctttccacttccccagcttctgccccaatacacatacctcccttaagccaggatgggggaaagagtgggattaggctgaagtggcttagaaggcctcagccatgcttggatactcacattaggaggaccatgtggttggaaggatagactgccccctacctcccaccaccaccatgaagtttggtgacttgaggctggagctccctctgttacctttccatctagcaagttcccaaaggcaagactctctctgatggtcactttgtggtctgtgctttcagaaatacaggaatctgatatcaacatatcctagggtttctaccaatctctgttgaaagaagccagggtttgccactgtgaagcttgatttctgctggtgacttctgaccataagctagaaccatggtcgccactgttttccctctgtagtttctcaagtgaacactctcaggatacccagttccctcatagcctctgttctcagagaattggagttggcccaagaaacataaacatataaccacccatatctatcctggattctgaactcttcaatttggagtgactaacacaagttgttatctaaacctttaaacctatcttccaggcagcccagagaagatctgtttccctgtgtcctgtgaatggaaggacccaagccaatatgttcctttgaaaagagtccagtacccaggccccatggaaaggtctgaaaataatattccagattacactgtacctggcttctcttcttcctttcctgctcagcctagatccttcttccttaaccccaactctttgggagaagggagggaaaatgcaagggccttcctctcttaacacggatgctcaagtaaaactagattcacagggcacagattccccagaaagttaacacaatcccaccatgagggatgggtaaattctcagatttccaaactgctgtacagagcctctgagaattggtgatgctttgttaaggtttgggcaggagcagaactctgtggctggcagccactattctcagttacacctcccagtgcccttctgaaaagtgccagctatttcattaggcaatgctggaaggaaatgaaattataccttctgatcaaataaccatggcttccctcagccattcctgagacttggtataaaatgaagaaatcagtgtcatctctactctcctctgccatgaggccattttcagacaagtt

SEQ ID NO: 379 - DNA, 1682 bp, Homo sapiens
ggcgctgcggagggagggggcggcccggcccggcccagctctgcccccggccggcccgaccccggccccggcccccggacaagcccttatctgatcccagctccgggtttaagagtcctggcccggcccgtcgcacagctctgctcctaactcctgcccgccccgtccgtccatctgtcccgctgccccgcggcccatccaaggggccactccacctcggacccaagatgacgtcagttgccaaggtgtattacagtcagaccactcagacagaaagccggcccctaatgggcccagggatacgacggcggagagtcctgacaaaagatggtcgcagcaacgtgagaatggagcacattgccgacaagcgcttcctctacctcaaggacctgtggacaaccttcattgacatgcagtggcgctacaagcttctgctcttctctgcgacctttgcaggcacatggttcctctttggcgtggtgtggtatctggtagctgtggcacatggggacctgctggagctggaccccccggccaaccacaccccctgtgtggtacaggtgcacacactcactggagccttcctcttctcccttgaatcccaaaccaccattggctatggcttccgctacatcagtgaggaatgtccactggccattgtgcttcttattgcccagctggtgctcaccaccatcctggaaatcttcatcacaggtaccttcctggcgaagattgcccggcccaagaagcgggctgagaccattcgtttcagccagcatgcagttgtggcctcccacaatggcaagccctgcctcatgatccgagttgccaatatgcgcaaaagcctcctcattggctgccaggtgacaggaaaactgcttcagacccaccaaaccaaggaaggggagaacatccggctcaaccaggtcaatgtgactttccaagtagacacagcctctgacagccccttccttattctaccccttaccttctatcatgtggtagatgagaccagtcccttgaaagatctccctcttcgcagtggtgagggtgactttgagctggtgctgatcctaagtgggacagtggagtccaccagtgccacctgtcaggtgcgcacttcctacctgccagaggagatcctttggggctacgagttcacacctgccatctcactgtcagccagtggtaaatacatagctgactttagcctttttgaccaagttgtgaaagtggcctctcctagtggcctccgtgacagcactgtacgctacggagaccctgaaaagctcaagttggaggagtcattaagggagcaagctgagaaggagggcagtgcccttagtgtgcgcatcagcaatgtctgatgacctgttcccactcccccattcctctggtctcttttcctctcttccaatgccctggtaaggaatactacccgggtttactggagatcccccgaaagaggaactcggaggacaatagggaggggaagtcttggaaaatctaccacttacactgtgtgtccccatccccagcagcgtcctgccactgtagcgcctttttaaaataaataaaataaaataaagcaccattttgtttccctttcatgaagtacactgtatttccgtcttccacaggggtgggagctgctattgctctagcccctgaaatcaaactca

SEQ ID NO: 380 - DNA, 374 bp, Homo sapiens
ttaggaccgtcccgggctgtgacagcttcaaaccagcagaattaagacccaaaataggtgaagaaatctcagcacctcactggatggtagtactggtgacctccagcggaaaggaagttggactcctagcaaatgaggctgggaaagaagggggcagtagggcttgttccaggagagacctcttttgttcagttttttttttttagctgtctcactcagtttggctttcctctgaagggccttgatcaggtgtataggaacttaatccttcccagacacaggtctctttcttgaggggaggaatgagttaaaaatggttgcccaaagtaaattacctcgagttgtatacggtggtcgtgcagtctgctcttctg

SEQ ID NO: 381 - DNA, 511 bp, Homo sapiens
tctaaagtcgggtaatgtccaaggtgacctcatggcctcaggaggacaatattaaaatttctaaatttttccatcatataattttttaatttctggaaattttttagtagctgttttatgatgttcatgataaactaggacagcaacacatgcgtgtaatttagaaagaaagaaaaatagaggcgtgtgtgcaaaaggttttactgacatagatgcatgatcaaaatatctaagtcctctccggggttcaggctagcagggctctgaggcattttgggggtcaggggaatgggaaggcatcagaacagcactgggagacttgggctcctccctcaacttgctgtgtgtccttgggcaagccacctaatctctctgagtttataaaacaagcagaggaagcttataaaacaagtacatgcaggctccttctagcaaggggaggttgagatgatctgattctaggctttgttccagatctcagataatcctggaatcttgagactttgaaagt

SEQ ID NO: 382 - DNA, 275 bp, Homo sapiens
acactagacgttgcttagagttcagcttgaagccatgtgatgtgggtcactgcccaggaggacttttttctagtgctgtggcctggaggactttccctctagcctctcatgcaggtgtactgtgtgatgtggtgggtctcttttctaacaggaagccccagtgggtgcagcagagctgtggctctcccaactcaagcacatctccacagctagctgccggcaagtacgcagctctcttggtggtgtctgagaaatggagcattaagccctcagtc

SEQ ID NO: 383 - DNA, 484 bp, Homo sapiens
ctactcgtctatatactcaattgagtaatttaggttcaggatcacaactaatttagattcataatcacagtccagttttcttttgttttttttgagacggagtctcgctctgtcgcccaggctggagtgcagcggcgcgatctcggctcactgcaagctccacctcccaggttcacgccattctcctgcctcagcctccagagtagctgggactacaggtgcccgccaccacgcccggctaattttttttgtatttttagtagagacggggtttcaccgtgtcagccaggatggtctcaatctcctgacctcgtgctccgcccgtctcggcctcccaaagtgctgggattacagccgtgagccactgcgcccggtccagtttttttttatctatcatgttcacaaagtaaaagtttactttctccttaaattaaaagattgagtaacctctaaagtttcatcctgctctaatatgcagttaaaa

SEQ ID NO: 384 - DNA, 638 bp, Homo sapiens
tgtcagagagactgggtccatatctataggcacaaaataaatagatctttactgtgccaatccatatgctttgtgctttggcagcctgagcagtagattgtcattcagctgacgtggccccatgcagtttttactaatccagaggacagctagaaggaccaggcctgcccagaccaggctcacaggaatcctgatggaagcctgaatgtgccctccttctcgacggcgacactttgtctgctgggcagccctgggaccttgctccttgtctttgctgcaacatgcaggttccggcgatttccgagtggaacctttctcccacagtcaggactcaatatagtcaggatgcactagcacagctgtttctcagagccacatcctcagcctccacagcaaaggagactttatttccaaaccagtaacagcccctttttcccccttagtaatctctgtgtttttactggctacataagcattcactttgaggtgccaacttttctctctttcttttccccaatatggatgaaaataataaatgaaaaattttgctctcattaaccagccactgtgtctttagtagtttactggctcccttcctggcctaagagcaacgctttttgcctttgatgcagcaccct

SEQ ID NO: 385 - DNA, 267 bp, Homo sapiens
aaaaagcattatcttcaaatatgaaagattaatttgtatctactgtaaatatgtattaccagccttatctgcatttatacacactgtgtgtgtacctcagtgaccttttataaaccggaaaaatggttgatttaataatttgttatgtaaatacaaagttgtctataaattggaaaatttgatgccagatggcttcataatatacaaatgtgttttgtaacatcatgcctttatggattaagtataaatacactggattgtctatgt

SEQ ID NO: 386 - DNA, 425 bp, Homo sapiens
cccagctacttgggtggctgaggggcagagattgcagtgaattgacattgaaccactgctccagcctgggtgacagagcaaaactctgtccctcccccgccccccaaaaaaacaaagaaaagataaagctcattaaaaaaacaactatgaactaattctcttatgaatatagatggagaaattttgaacaaaatactaaccagttggatccagcaatatataaaaaggattatacaagtgggatttatcccagaaatgcaaagtagatttagcattgaaaataaattagtgtaatataccacagcaatagaataatcaccatgtgatcatctcaaaagacacacaaaaattatgtggtacaattcaatactctttcatgacgaaaactctcaatatgctaggcatagaaaataacttcctaaact

SEQ ID NO: 387 - DNA, 465 bp, Homo sapiens
agtctgccccaggagttgcaccaaggggtgggactgagctgggtctgctgaggaagctgtgccagtgaaggggcagcatgccaagccaagaagccgtgggtgcagagcctcatcgcagtgggagctggcctgtcgggaccagcatgggctctggagggccagtgtgtgggcatggaggagttttggacaagctattttaacctgcgtaatgctcacttatctttggccaagtgggggcacttcctcacgaggtcagcatgagaattaaatgttatagttcatagtagctagtcactaaatgtttatttttgaaaaatagatgggtgaatttaaaaggagatgacaaccaggcatggtggcacatggctttaataccagctacttgagaggctgagggaggagaatcacttgagcccaagagttcaaatccagccagagcaacacagtgagaccttgtctctttaa

SEQ ID NO: 388 - DNA, 350 bp, Homo sapiens
tgggtttaggcattcttttgggtcccgtccagcaatagcacccaactaaaacatgcttttcttatttctgggcctgcccatcctgacagaaatgcctcacaggtcagaaagacctgaaagtttccaaagctgcgataggcagtaacaccacctcttcccagtgctcctcctagactttgtgcaacacccaaactcaggcccacacaaaccgcaagccagagctaggtcatgctcacagtggcagagagtcatgggctggtcacaagtcctggcccagccacttgggccagccacacccacctccgtgaacctgtttactcatctgcaaattggcgacgatatgttcctca

SEQ ID NO: 389 - DNA, 617 bp, Homo sapiens
tgtttacccctaaggacattcagaatggaaggaaatctggttctagtatctatgacccactgactgctaggattgatgcaacagctgctcattatgtaagacttttgtcctcaattcttcattcctaaccaaaccagtaattcagaattgattaggacttttcttagcacatgaagcctctgctttaactaaaggcatatgaatagtggcaggtacctgctagaatatccaagcataaaacttcaatagaaggaactataatgaaatgcctaaaggaacttaaatatgcaaaatggaggaataaaatatagttcaggctacatttcacccaagtgacattatgccattacaaaagcattttattaaataagacaataaaagaagcagaaccttccatttggtaatcaataatcatacagatgtgagaaaagagacactagaggaaaatatagacaaatgatgatagtgacattatctgggtcatcttattttctcttttacactttgtttttcaaatatatgacaaatatttattttatcatcaagtaaagaaaacctacacattaacattcttctttctcctcttctgccccacccccaaaaaggtactaactcta

SEQ ID NO: 390 - DNA, 487 bp, Homo sapiens
gctacaaaatgtttctgatctagaaaaacactggcctttgacagacatatgttctcatagcatctgtatgtacatgtgctagactgcaagagatgatgctaggacaggcccccaaagtccagaccttgactgagctaagaggtcagcatcttgcctgtctccttcatcttctgcttcttcatcctagtggtctaccaccttctctcatttattttttctctccccagtctctcacattctccttttttttctacttaattttttctctttctgaaattcgtcatcatttgaaacagaagttagtctcttagttccatttatctagaaagtttagttgtttctatgttcagtgtatgttcatttcttctccaaggatgatacaccgcaggtatatgatagatatactttgtaaaatctttcaattgttcatgcttaattttaacagtaactaccaagaatgaaattcggctttaaggattgataacta

SEQ ID NO: 391 - DNA, 968 bp, Homo sapiens
gatatgaagagatcaaagaagaaatacaaatggccaacatgtagatactgttcggtccacttgtgattaaggaaatgcaagatcagaatatcttctatttaatttggaattattaaagtttatattagttttgaaatgtttagttttgaaaatataggagaaagctttctcctgtacctttgtacaaagaaataagagtggaacgtgtgtatgtggtttgcgtgggttgggaaatctacctactacatgattgatggccttgctcccaggaagtagtgatgtggatctgagtgagtatgggtgggagcattttaattttgtaattctaatttcaaaagagatttttattttattatttttttgagacggagtctcactctgttgcccaggctggagtgcagtggcatgatctcggcttactgccacctctgcctccagggttcaaggtgatagaagagatttttttgaaaaaacagtgaactaattgtttactaggccccattttaattcagtcagtgttaagagttcaagcatcaagacaatctagtttatgttcaatgtaaattttctagttgctagaaatatttggatataatacagtcctttgctagaactgacattttaatggtgggaaaaactgtcagcctttagagatgccttttttcaagtttccgtgatactaaagttcccagctggtaacaaatgtatctgcttccttgagtttcaatgtccaggcctctttaaagtattcaggtatgcaaagacaggattatgcaagtttcttttagttggacaacctttattgatgaatttcttaggtttctgtggtagtgttgttagattaaatacagtcattccctcttgtctagtttcgttttatgtgatttcgctcttatggtttcacttaccccatggttcgaaagtattaaatgaaataaacaattcctgagttttaaattggaaaaaat

SEQ ID NO: 392 - DNA, 780 bp, Homo sapiens
aagctgcagactggtgaccgccctcagatggtgtcctccctcattgttgtcttagtaaagatgtgttcctgttagcaagctcactcagtactctatagcttatgttgtagttccatcatagtgcagctagctcatcttgccaggggtgttcagaacttaatctctttgaaagttgtccttggtggaaataaaaacattatctcctttttactcttgttggaaactcaagtttgctgcggggggaagggtggcagggtgtgaggtatttcaggtgcagtattaatattatgtcttatgaaatagcatcagccaacacgaacacactcaggaattatatctctcaaaagacagaaggcaaaagggagggactaaaatctaccttgcatgttaagtaaaagcattaacattctagtgagatgacaaagttttgatagcgattatctaaagccaaagaaaagaatctgcctggtagtaaagttgggtttttttggtttggttttgttttttttttgagactgagtcttcctctatcccccaggctggaccgcaatggcacaatttcggctcactgaaaccttcgcctcccaggttcaagcaattctcctgcctcagcctcctgagtagctgaagttgcaggcacctgccaccatgcctggctaatttttgtatttttagtagagacgggtttcaccatgttggcgaggctgatctcgaactcctgacctcaactgatccgtctgcctcagcctcccgaagtgttgggattacaggcatgagcca

SEQ ID NO: 393 - DNA, 535 bp, Homo sapiens
agagctagcaccatgagcttcaataccctgtagactatcttatcgaaacccgtcatttacaaacgcagaaaaatgaggcccagagaagaagtggtccaaggacacacagctcacctggagcagagtcaggaccgtccccctctcacaaatcccaggaatctttccactactacactaagctgcttcaacctttgtgtgagtgccacagtcacctgagatgatggcaggaatgaatcagtgttggaaaccctatacaaagtgaatggagagcaacagaagagtcggcaacagaagggtccccagggcagtgtgctggtgcctgaaaatcttaccactcagaaagcagaagaattttttcagcagaagctcacctgagaattctcactgctaatgactcctcaaagatcagtggggtccttacattttggggaatcatcaacctcagagaaactgatgaaagctttgggatctttcttcttttttttttttttctgaggcggagtcttgctctgtcgcccaggctggagtgcagtgg

SEQ ID NO: 394 - DNA, 546 bp, Homo sapiens
gtctcaaaaaaaaaaaattaaaaattaaaaaaggaaccctgtagactatcttatcgaaacccgtcatttacaaacgcagaaaaatgaggcccagagaagaagtggtccaaggacacacagctcacctggagcagagtcaggaccgtccccctctcacaaatcccaggaatctttccactactacactaagctgcttcaacctttgtgtgagtgccacagtcacctgagatgatggcaggaatgaatcagtgttggaaaccctatacaaagtgaatggagagcaacagaagagtcggcaacagaagggtccccagggcagtgtgctggtgcctgaaaatcttaccactcagaaagcagaagaattttttcagcagaagctcacctgagaattctcactgctaatgactcctcaaagatcagtggggtccttacattttggggaatcatcaacctcagagaaactgatgaaagctttgggatctttcttcttttttttttttttctgaggcggagtcttgctctgtcgcccaggctggagtgcagtgg

SEQ ID NO: 395 - DNA, 450 bp, Homo sapiens
ccttgcttatataaaacaggttgcagtaaagaagccaacccaaacccaccaaaaccaagttggccacaagagtggcctctggtcctcctcactgctacactcccaacagtgccatgacagtttacaaatgccatggcaacatcagggagttaccccatgtggtctaaaaaggggaggcgtgagtaaactaccctttgtttagcatattatcaagaaataaccataaaaatgggcaacaagcagccctctgggtttctctgtctgtagagtggcctttctttcattcctttactttcctaataaacttgctttcactatactctacggactcaccctgaattctttcttgtgtgaaatctaagaaccctctctaggggtctggattggtatccatttccagtaacaatactacttacctttcttgatggttataaacactaaatatgttgg

SEQ ID NO: 396 - DNA, 385 bp, Homo sapiens
acctgggaggcagaggttgcagtgagccgagatggtgccactacactccagcctgagtgacagagtgagactccatctaaaaaacaacaacaacaacaaaattatgcaaccagtttatgtccaaaaatggctatcattaaagtactaagatttctcaaaataaagtggtgatattttttggtgtttaatagcaattcacatgattttatcaaaatagtatttaagtcaaaatgttggtgctagaagtgattttaaaaatcctaatcaggccgggcgcggtggctcactcctgtagtcccagcactttgggagactgaggtgggtggatcacgaggtcaggagatcaaggccatcctgtccaacatagtgaaacctcatctctact

SEQ ID NO: 397 - DNA, 469 bp, Homo sapiens
aatatttggtgctttttggaatatctagaacacatggcaccccaccttgcagaatagtttgttcctggttgaaggctgtctggaaaagaatcagctaatcctgcttagaaggttaatgcagtgcaaagaaagagagcactgaggtgagaccaggaaagcctgtgtatccagtgatagcaagggcattctgcaggatattgcagcattgagatcttttcacaccccttatttagttgatccaaatgaatttgtggatcctttttttcccaagcaaggaaactaggacttgaagagtgactcttggctgctttaaggccaaatactgtattttaataagttctagaaccaaggctaggttccaggtcttctgattttctagaattttttctagaattgtttttcttttccctgctatgccatccacttagtggcaaggtagttaacctatctccactgtagtttcttctga

SEQ ID NO: 398 - DNA, 474 bp, Homo sapiens
tgactaaagatagatcattggtgtcctcttccctgaagagctttaaaaatagaagccactcccttgtctagaatgatttaaagttcattccttccagtatagttaattagctccgataccatttatatttatcttattatttaattgctattgatttacatattgtcaagaagtttatagtgtatagtacctatgttggcaatgtgtagctaatgagaagcaacacttttaattattggtcattgaaactatcagggccaagggaaaacttcccctttgccctctgaagttttgttgaaaatgaccgacaagaggcagattaataggcaaaaagggcccggctcagtggctcatgcctgtaatcctagcacttttggaggccaaggtgtgtggatcgcttgagcccaggagttcaagaccagcctgggcaacatactgaaactccatctctacaaaattttaaaaaatcagccg

SEQ ID NO: 399 - DNA, 442 bp, Homo sapiens
atctccagaaaagttgtgaattagcttctcagtttgataatggagaaggcaaaatgactgcagaggcaattcacacatagactactattgatatatggcagtaattatgtgattgtgtatatacatatagatatctaaatatatatatatatacgtgtgtgtgtgtgtgtgcgcgtatctcaaagtgtagataaactttacccccaagcgaggcatgagagttattagtgttgatcatttgatagaatctagagcatcatctcatcctggtaacatattagaatcccttgggtagcctttaaaacatgccagtgcctgaactccacctgagaccaacaaaagccaagtatctgaaggtggggcctaggcactcatattctatatggccctaatgattctaatatacgagctgaaaccactggcctagtgaaaacacagaaag

SEQ ID NO: 400 - DNA, 478 bp, Homo sapiens
  misc_feature (457)..(457): n is a, c, g, or t
tttttttttttttttcaaatattctttatccatgtttggtcaaatcagaggatgcagaattgtggatacagagtgcctcctgtaacaatgttgacagtgaacccaggtctctttccaaaggctctttctatcacaataactgcctcttccatgtatcctacaaagcaaactaactacatctccatgttggttcagaatattaaccagaatgtacttcaaaaaaatccagttctaatgtagttagtatattgtaattatttgactgttgaataaattagaaaaaatatatctgtatattacctgtatatatgtgtgtatacatatatgtgtgtgtgtgtgtgtgtgtgtgtgtatctttgtttcataaaccctgtgatttggagaaagagtatgtgtcagagcttaggaaataccattccatataataatagccgtcgacgcggccgcgaatttagtngtagtaggcggccgctctaga

SEQ ID NO: 401 - DNA, 335 bp, Homo sapiens
  misc_feature (314)..(314): n is a, c, g, or t
tttttttttttttttcaaatattctttatccatgtttggtcaaatcagaggatgcagaattgtggatacagagtgcctcctgtaacaatgttgacagtgaacccaggtctctttccaaaggctctttctatcacaataactgcctcttccatgtatcctacaaagcaaactaactacatctccatgttggttcagaatattaaccagaatgtacttcaaaaaaatccagttctaatgtagttagtatattgtaattatttgactgttgaataaattagaaaaaatatatcgtcgacgcggccgcgaatttagtngtagtaggcggccgctctaga

SEQ ID NO: 402 - DNA, 381 bp, Homo sapiens
gcttccattacccttaggggaaaaaccccaaaatgaaaccttgggcatgtcttcatctcatactatgctcccctttgcacaaggcactttggtcccctgaccttctctcagaagtgttaagggaaccatgctcgtttctctccccattggagaattagtacagatttccctctgcaaaggaagctccttgtcacccagcatcatccccttcttagaatttccaggcatctttcaaaacaaagtcaaaaatcattgcttaccatccctccctagactaacctggccccctggagatgtggcttcagaacattctgtccttgctgagttggagcttcataattaattgtgaggtgtcttcctccgttggtggaatgtaaactc

SEQ ID NO: 403 - DNA, 378 bp, Homo sapiens
tctaaagctatgagaatgtatttgggggaagaacatgctcattggcaatattctactgtactctgaaacatactctagagtcaatgtctaaaacaggaaacaggtagtaacaaatgaaagaatctggtgtattagtaggcagcaaagcaagtgtagctttataatatataaatctgcccttgaggccaggcacggtggctcatgcctaatctgattatttttgtgaaagacttcaggtaaaacatagtgtatgcagtgatcactctcagctagcaaacttagagaaggctggcaatagtgacaagtgtagtttccatttactaattgatttactatgtgccaggcatggtggcagagctttttatgctatcttatcca

SEQ ID NO: 404 - DNA, 447 bp, Homo sapiens
tctccttctgttgaccaggctggtcttgaactcctggcctcatgagagtctcctgccttggtctcccaattcttttaactttttaaataaaagccattctgactggtgtatgatgacatctcaatgtggttttaatttgcatgctgataattggtgatgttgagcattaaaaaatatattttaaaaggcctttgatatgtctccagttccagtcacggacttccatcacacgataaatcctaacaaagagaaatttggctgagcccagtaaatgcaggaactatgagagataatatttttaaatgttattttaatgcaactaaatttagagtggtttgctatgcagcaatagataaaaggagcagtcctgaaagcaaactaattttgtttgtaccttttctctctctctcactatgttgcttttttttgcaaagttggccagtttat

SEQ ID NO: 405 - DNA, 586 bp, Homo sapiens
gatgaataacaggataacacgttgttacattgtcacaactcctgatccaggaattgatggctaagatattcgtaattcttatccttttcagttgtaacttattcctatttgtcagcattcaggttattagcggctgctggcgaagtccttgagaaataaactgcacactggatggtgggggtagtgtaggaaaatggaggggaaggaagtaaagtttcaaattaagcctgaacagcaaagttcccctgagaaggccacctggattctatcagaaactcgaatgtccatcttgcaaaacttccttgcccaaaccccacccctggagtcacaacccacccttgaccaatagattcatttcactgagggaggcaaagggctggtcaatagattcatttcactgggagaggcaaagggctgggggccagagaggagaagtaaaaagccacacatgaagcagcaatgcaggcatgcttctggctcatctgtgatcaccaggaaactcccagatctgacactgtagtgcatttcactgctgacaagaaggctgctgccaccagcctgtgaagcaaggttaaggtgagaaggc

SEQ ID NO: 406 - DNA, 338 bp, Homo sapiens
aatacacctcgtaattttcatttttaagtttacaggcctacttcactttgaaaatgaaaaacaactcacaaaaaaccagatcttgctcagattaatattggtctaaatttagaatttctcctacaacaggaactttacgttaaatgcatccaaatctttatttatcacacaccacagtataatatagataaaaagtacaacaaacttagatttaaaaaaccaaatgtccgaaggttaagttacacaacaagttaaatatgagagctcactggagaaaatgaatctttacaaacttcccctaagtcagaacgctttcagaatataacttctttattttg

SEQ ID NO: 407 - DNA, 1075 bp, Homo sapiens
aaaaaaagatggcatttcaatatgccaaaccacagatatgatctaaggctagatttgcatgtaataatgaaagtggccaccgtgtgtaatgtgagtcaggcccttctaagcactttacttgcgaagtccaagctattactacgttcttctgaggcagagcccattaaagctcccacttagccagatatgttcctgagttgccacttcatggttaagtgctgccccaagtaccccaggtgcctggccactgtcctggcagtggcctttgccccttctggatacccaccagcctctcatgattcacaaggggccagcagggcttcttcagttccagctctagccctgaggctggcatgtactctgattgttcagtgccttggtttcttcctgcggctataacaaaataccttagtgtaatttataaagaaaatgaacgtattgttcagagttctggaggctgggtcgtttaagatcaaggtgccagcagatcccgtatttggtgaggactgttctcaccttccacgatggcgccttcttgctatgtcctcacgtggtggaaggaacaaggcagttctcttcaacctcttttataagggcactcatcccatttatgagggtggtgctctcatgactttatcactcccccaaaggccccacctcttaatactgtcaaattggatatcaggctccagtaatacaaattttggggggatactgccattcagatcatagcactacccatgtcatgctggtggttacatatttttcaaagatgcctgggtactctttttaatcagaaactgtggtacagagcaagaattgaacctgggcaggtgggctccagagtttgtactgtccctttgccctcaggttcagaaacccacatgagaactgtgcatttcctctggggagagggagttggaacaagagatgcagctgaagctttagcagaattggatgtttacggccaggtataatcatctgtaatcccagcactttgggaggccgaggctggaggattgcttgagcccagaagttcaaaaccagcctgggcaacatagcacctgtctctaca

SEQ ID NO: 408 - DNA, 1891 bp, Homo sapiens
ctcaacgctttatacttccccggcgccgtcgcctacgcacctcaacgctttatacttgtagaagtctctgttgggtacacgggtaacaaatgtgaaaaaatataattctgaggaagggagatacaagaaagctttcatttaaggtagttgacacctaagtcttgctctgtggttgacaggtaacaggtgtaagttgttcaagccagagattactagtttggcttcagaagacatttgtcaaggtagaagagtacaatttagaatctgtgtattcatgataataaaagctctggggaaaatggggacaaataaaaaatagaatcctaacagatactactgggtagagcaagaacatatggacagaaagataatgttggcagtctttggatatgtaatctatttaaaaatacaacttctaagtaagtgtcttatagagcagaagcaggaggatcacttgagctcaggagttcgagagcagcctgggcaacaataacgatacccccctttccacaaaaaatacaaaaattagctgggcatggtaacgcgcatgtccgtagttccagcttctcagggggctgagctgagaggatcacttgagccccggaagttgaagctgctgtgagccgtgatctcgtcactgcaccccagccagggtgacaaagtgagactctgtctcaaaaaaaacaaaaaaacacagaacttctattgtatacaagaaatgccataagcagtcaaaataaaaaataatttaaatttgtttacataatgacagataaaagattgtttgttttatgacgagaactcctaaaagctaacaagaagacaataggccgaaagaaaaataggcaaagagtggagcttgacagtacatagaagagtaaatcctcatagaagggccaggcgcagtggctcacgcctgtaatcccagctctttgggaggccgaggcaggtggatcattttaggccaggagctggaaaccaacatggtgaaaccctgtctctactaaaaataaaaaaaagtacccaggcatgtggcgggtgcctgtaatcccaactactcgggaggctgaggcaagagaatcgcttgaacccaggaggcagaggttgcagtgagccaaaattgcaccactgcactccagcctgggcagcagagtgagtgagactctgtctcaaaaaaaaaaaaatcctcatggaaggattacttctaaatcgaggccgggcatggtggttcacacctgtaatcctaccacattgggaggtcgaggcaggaggatctcctgaacccaggagttcaagagcagctgggcaacataacgatatcccgtctctaccaaaaattaaaaattagctgacacaaaaaaattagccaggtgtagtggcatgcaccttatagtttcagctactccagagggtgaagtgtgaggatcactggagcctggaaggttgaggcagcagtgagttatggttgcttcactgcacttcagcctaggtgacagtgagaccctgtctcaaaaaaaaaaatatctatcaaaatgaaaaatacacccttcaactcagcaactccccataattatatgggatttgaagcccatagaaataaaagcactagtgggtaaagatacatgtctattaatggcattatttatagtaggaaaaagtggaaaacaatgtgagaatactgtgagttggggaagacataacatctctaccacagaatatttgtagccattaaaaaggatatttgagctatagcgtttgactttgcataatttccaagaaattaaggaaagcttttaagaatggcatgtttaatatttaacttttggaatgagattatataagaattataacaactacttatagcttaatctgccaatctgtcaacatcctc

SEQ ID NO: 409 - DNA, 1945 bp, Homo sapiens
ctcaacgctttatacttccccggcgccgtcgcctacgcacctcaacgctttatacttgtagaagtctctgttgggtacacgggtaacaaatgtgaaaaaatataattctgaggaagggagatacaagaaagctttcatttaaggtagttgacacctaagtcttgctctgtggttgacaggtaacaggtgtaagttgttcaagccagagattactagtttggcttcagaagacatttgtcaaggtagaagagtacaatttagaatctgtgtattcatgataataaaagctctggggaaaatggggacaaataaaaaatagaatcctaacagatactactgggtagagcaagaacatatggacagaaagataatgttggcagtctttggatatgtaatctatttaaaaatacaacttctaagtaagtgtcttatagaaaagatagaggctgggtgtgatggctcatgccagcaatcccagcactttgggaggcagaagcaggaggatcacttgagctcaggagttcgagagcagcctgggcaacaataacgatacccccctttccacaaaaaatacaaaaattagctgggcatggtaacgcgcatgtccgtagttccagcttctcagggggctgagctgagaggatcacttgagccccggaagttgaagctgctgtgagccgtgatctcgtcactgcaccccagccagggtgacaaagtgagactctgtctcaaaaaaaacaaaaaaacacagaacttctattgtatacaagaaatgccataagcagtcaaaataaaaaataatttaaatttgtttacataatgacagataaaagattgtttgttttatgacgagaactcctaaaagctaacaagaagacaataggccgaaagaaaaataggcaaagagtggagcttgacagtacatagaagagtaaatcctcatagaagggccaggcgcagtggctcacgcctgtaatcccagctctttgggaggccgaggcaggtggatcattttaggccaggagctggaaaccaacatggtgaaaccctgtctctactaaaaataaaaaaaagtacccaggcatgtggcgggtgcctgtaatcccaactactcgggaggctgaggcaagagaatcgcttgaacccaggaggcagaggttgcagtgagccaaaattgcaccactgcactccagcctgggcagcagagtgagtgagactctgtctcaaaaaaaaaaaaatcctcatggaaggattacttctaaatcgaggccgggcatggtggttcacacctgtaatcctaccacattgggaggtcgaggcaggaggatctcctgaacccaggagttcaagagcagctgggcaacataacgatatcccgtctctaccaaaaattaaaaattagctgacacaaaaaaattagccaggtgtagtggcatgcaccttatagtttcagctactccagagggtgaagtgtgaggatcactggagcctggaaggttgaggcagcagtgagttatggttgcttcactgcacttcagcctaggtgacagtgagaccctgtctcaaaaaaaaaaatatctatcaaaatgaaaaatacacccttcaactcagcaactccccataattatatgggatttgaagcccatagaaataaaagcactagtgggtaaagatacatgtctattaatggcattatttatagtaggaaaaagtggaaaacaatgtgagaatactgtgagttggggaagacataacatctctaccacagaatatttgtagccattaaaaaggatatttgagctatagcgtttgactttgcataatttccaagaaattaaggaaagcttttaagaatggcatgtttaatatttaacttttggaatgagattatataagaattataacaactacttatagcttaatctgccaatctgtcaacatcctc

SEQ ID NO: 410 - DNA, 859 bp, Homo sapiens
tggccaagttatagtctgattctcatttatccaaggtagtgggcattaggatagcagaggtcaatgtcatccagtaagggcagtttcaccttgactgattggagaggtgtaatcctaccaggcagtggagctgtgatatttcactgtttgaaaagtagaaaaactgaggctgagagattaagtgccaggtccaagcaagtgagtgacaaaaccaggacaaaaggcagactccaaacaaatccctatcctactgctttgacggatcccatctcagaggtgctgtcagtgaaactgatcctctccagtgttgttctagccatctcaggaaagactgattaagccctggagagatcacaggaaggcagcagatgggagagagaagcaaccacagaaatcctgaacatgctgcagattctgtagtcaaattcccaactaacagctggacgttagtatcccttggggttggagacagggattcttagcttcagttttttctgttatgctgagtattctgcatttcaaaaacatagtaacttgtaatgcttctacaatttgtaaaatacaaaataactggctgggcgcggtggctcacgcctgtagtcccagcactttgagaggccaaggcgggcggatcacgaggtcaggagatcgagaccatcctggctaacacggtgaaaccccgtctctactaaaaatacaaaaaaaaaaagttagccaggtgaggtggcaggcgcctgtagtcccagctactcgggaggctgaggcaagagaatggtgtgaaccccagggggcggagcctgcagtgagccgagatcgcgccactgccctccagcctgggcgacagcgagactccatctca

SEQ ID NO: 411 - DNA, 1798 bp, Homo sapiens
agactgagaattaaatgagataactttgtattcaacagtaagtagttgaaaaacattacatattatgatgttgagtaaactacacattgggcactacgagaaagtaaaaagaaaatcaaataatcttaatactctactatggcaaatgaatagtatgctggaagtaaatgtaaggacatgctcagataggaaatttaggtagctggctcctgtgtaatgggctggagagagtggatcataaacaaaactattaagaaagctataataattcaggcaaactctatgtggcatagcaatacaggctgaactggagtgttgttcaacacaggttgaaatgcagtgtagaatggagactttctgtgcctagaaccatgagcttcggaaaatctaagccatagcttaggagataacacgctttaatcatcttctaccttcaccttaataatttaggggattctaagaaatcatgactcttctaggtaccattttatagataaaactgaggctcagagagcaaggccatcattgcattattaatggaggacactattcacactgcagtctatgaaaatgacaccttctggaacacaacaaaaataagtgatggctcccgaagttgtgcaccgcagcagccctgtcagaaaggttacaatgtaagggtagatagcagaattgatctctatctaaaaacttgtgcttttcccactataacatactatctcttaccatggtatcttatttatgggtatgtagcatacctagggttaaacactgaattaaaacaaagaaacaaatcaaacatatcccagatatgggtttttcataagaacttcataggcttattaaagtgaatttaatggaatcctgtaagcactagctacttaacaacaaattaaggtgcttgatatattcttaaaccattacttaatgggaaaaataagggtaaaacagatataagagcccaaccatttactttggacttgtccaaaacagataaggcgctttacaaaaaacaaaaacaaaaacaaaaaaacctcaaaggactaacacaaaaattaagatcataaatcaattttctgcagacatttcttgaattatcccaaaattttaaggtcaatttcccccccaaaatgtttttatcattgttatcttggcaaaaaatacctaatcttagtaagaagcacatatttaactagttatttaaatataaaaaaagatttaattcatatttatgccaagaacactacaatttacaaaagtttcatccaaactcttaccctatgtctacccacaccagagggaggaacatgtctttgtggagaggatttctttgagactctaaatatgctttgttcaggaaaggggaagatacaaaaatatagaacaaaaaagaatattggctcattgtacacaagagaggccagccattaagaattgttatcaatacaataaaagggaatacttggccagagatcctctagataagtagctaaaatgtgatcaaaaggagaaagaggaagaagcaaatacacaaacgttttatgggtattaataaaaataaagacatctctgaacaaatgataaaatcccttccctgaaaaatttcaaatgagattcacagaaatgcagaagcagaagaaactttagatttagaaacatctcatttgggctgggtgcagtggctcacgcctgtaatcctagcactttgggaggccgaggcaaatgaatcacctgaggacaggaattcaagaccggcctgggcaacatggtaaaaccccatctctactaaaaatacaaa

SEQ ID NO: 412 - DNA, 314 bp, Homo sapiens
ttatactcaaggaagcatgaattgcaaaggaacaagatgaaactttaggggttatggatacattgattattttaattgtaggatgacttcacagatgtagacatctcaaaactcatcaaagtacacactttatgtgcactttactgtacactacttatttctcagtaaagccattacattttttttaaaaaactccccaacagcaccatttatgcttgagtagaaatgtaatttcagcaaaacattaataatgtagctagtttgaattttattggtgtgggtaaagttttaataaatcccttgtttgagactga

SEQ ID NO: 413 - DNA, 687 bp, Homo sapiens
  misc_feature (678)..(678): n is a, c, g, or t
ccgtgtggggtagcatgggtttggctctgataggctgcgtggtcagatcagactttgacatatcactacccttccccgtagcagttttaaatgcagcacaggtgatttgggaagacttcctaaatgtataatatttctttttgaaaagaaacttcacctactcatacgtctatacacctctctctgtattgcatcttggaatctgtgaacaagcccatgtctcccgggaagcgctcttctatcccaactcccgtttcacaggctcctggagactgcatgaatacaaactcctctcaccattgggatcccagggaatttgcttccttgtcttttgttctgattagagttcatttaagcatcacacttttctttctggaaatgttcttaatttaaatttaactaagcttccctttcttccagtctggcagcttccccaacattcatgaatacaatttcataataatatgtctagaaatgaggagtatccagcaaggagttttactctgtttctttaaacataaagacttggcctaaagagtgttttaagcaatgctccgctgccggttgtctcctccccagttttgacccttggccctttctctgtttttcttttcttttctttttttttcttttcttttctttcgaagttttgctccagcctggtgacaaagtgagggnccgtctcca

SEQ ID NO: 414 - DNA, 354 bp, Homo sapiens
agctccacaagggcagggactgtgctgttttatttatttctgtgtttcctgcacccggcatagagtagcacaatagaattttgttcaggttgggcgcagtggctcatgcctataatctcaacactttgggaggctgaggctggaggatcttgagcccaggagttcaagaccagcctgggcaacatagtgagaccatgtctctacaaaaacaaaaaaaaagtaattgagtgcagtggtgcatgcctgtagttacagctacttgggaggctgaggtgaaaggatcacttgagcccgggtgttcaagcttgcagttagctatgatcataccattgtactccagcctgggcaacagag

SEQ ID NO: 415 - DNA, 482 bp, Homo sapiens
tttcttttgttacggacacccatcatgtatggctcctcatctgagccatcaccgctcccgaaacacatggggcggcagctgctgtgcctccttctcaattcttccacccccccacaccatcagaattcggatttctctccacgtggcgtctgcctctgtccccttccaggctggagcgacgtttccacgttcggatgctgcagcctctgcacctgcctcagacagacccaccagataccacctgtctcttcgtggcatttgggagatgcgtgggcggcctgccccccgaccgccgcccctgcccaccacatgctgggacaaggttctggctggatgtcagaatggatgggggtgggggcagccctggccgtgattagttgaatgaatggggtcacaacatcccttttcctgcccctacagtttgtgttgcatatttgtgtttaaagcctattaaaataaacttgagggactttctgcgatat

SEQ ID NO: 416 - DNA, 325 bp, Homo sapiens
atgacagatgttaagagttttgtaaagtatatatcagtagctattattagtatcatttagctattaagttcttctaagaaccgtacaaggatatgaatgtcctgccaggaagtgactaatagaaagattatgccagtctctccccaacctggccatacaagtgaaggctcacttaggcaccgaggattatagccacagaggggatgttcaagaagaaccacgatgcaatgtcaatgtcctgaagatcctgaacactttcctcttcatcaccaaaacactgtacggctccagcctgggagacagagcaagactctgtctcaaaaaa

SEQ ID NO: 417 - DNA, 326 bp, Homo sapiens
tgaaccacccctgagaaaatgtgcagtgaccctgccagaagaagtagcttcaaccaacagagcaatgaaaattaaccatcttcatagggattgacctaaagcataggcaacaacagaattacatataaacaaaagtagaaaatacatgcaatcaagaatatgccattcacaatcaattgcctgaaagttttaaatttcatatgaacttttactttttgatttctaaattatttttcaaaattgtttatgctttaatcttatttgttaggatgaactaacgtattctactaaatttctcaaccaagataataaaatatgatctgtgc

SEQ ID NO: 418 - DNA, 384 bp, Homo sapiens
ctgggtatgttctgccagtgtgcaaggtggggccctccaggccctctcctcccctccctttttctagatgccatttcctgctaaagccacctctcccatggctataaactaccttcaatcagggcacgaactctagagcacaagagaacctgagattctttaaaacattctagtttaatgtcctcgttttacagataaagaaaatgggtacggccaagaccatagacctagtgattgtcagatgaacaattagacccacagaaccatccaagctacagaggacgcattctgccttcccttggatcctgtggtttgaggatggaggtctaggaccgtggcaggctttttgtcccatgagggaaggccatggagctgaggaagggg

SEQ ID NO: 419 - DNA, 376 bp, Homo sapiens
gcctcctgtcaatggctcactgcactgccacatgtgggacagggcaggagcagagccacgcgggtcctctgccggtgctggtgcaggtcccaggtctgagcttgtattcccgactgtgccgccttcctcctgatttgccatgtgatttttaaaaagcatggtcccttttttaaagttgtttttgaatcttttgagtctccttttgcagcaattttaggcctgtagaaaatctgccagtttagtccaaaaagtggtctccctcattcacctgagagccggctgccagcctcatgtcccgtcaccctgatgattttcatgtgctttacgaccatcggggcattgtcctgcacggccaccatgcagtcatggcactagg

SEQ ID NO: 420 - DNA, 458 bp, Homo sapiens
cgtgagccaccaagcccggccggcagtggtggtttaaaaagcatcccagtaagggcacttatatgcagcaaggatttctcctgctgcttatcatgctatctgtctcactgagatagatagacagtagagaaggaagagaaatatacatagaaccacaatggttggtagctttgatgggattaaaaaaatagattctaaaatagtaaaacataaaatgaatagcagatcttggcaacagagaggaaaaccagtgacatttgtcaaagatagaaaactttttggaggggaggcatttaaatattaactgaaagcataccaatctctacagcttaagtttttgggaggaaggggagacacagactacattcaatcaagccagatctttttgcccttgtcttgcatcatccatgtctatatccctgtataataatcatgaaagtaagccagaagtaaaaaaa

SEQ ID NO: 421 - DNA, 425 bp, Homo sapiens
ctgccttttctgatatattttttaaggaaatcctgttttgttagctacaataacttcatcattatccagggtgctccctttcattgtccctgtctggggaaagtcgttccacggctgacagacagaatcaagccctataaagcatttgttcagtccctgggcagtcactggagaattccttaacattgccctgcttgttctgatctcctccccacccacggcacttccatcggtccctagctgatcctcttcccgttaggtcattgcaatcccagcccacaaaacgcccacattcccaatgctcttgttcctgctgacgaagataagaaatgtgtcctgaaccggaagagctgccaggggagacacaagagggcctcggttcccctggtgctcacccaccaccatgcccacccaccaagacacac

SEQ ID NO: 422 - DNA, 505 bp, Homo sapiens
gataatttaaaagactcttgtggtgatggaattattctgtatcttgactgcatcaatgtcaacatcctagttgtgatattgttccatagctttgcaagttgttaccactggggaaaacttagaaaaggctccacagggtctcattgtacgatgtcttataattgcatatgaatctacaattaactcaacaattttttaaaaagctaaaatgattttttgtaactcagaattcataatacttctacttgaaaacattttgttcaagtcaggtgaagtctccaaattgctggtttttacttcattgttatccaatatcatcagcaaatctcacatctcactgatttctcactttacagctcagtttgctacaaataatgcaattcacctagtagacttacaatagcactccacattgtctcgtcctatcttcctatttgctattctccaccattgttttactcaggtgagcatcacaccatggctagttacctaccaacctgccaac

SEQ ID NO: 423 - DNA, 392 bp, Homo sapiens
gatgaggcatcaaacctgatcgttccctgacctcggcaagcaccattgaaaaaaagggaccgatgtaagacagaatggagccaggcaccgtggctcacacttgtgatcccagtgcttcaggaaaccaaggtgagaggattgcttgaggccaggaggtcaagatcatcctggacaaaatagtgagactttgcctctacaaaaaaatgaaaaacaattagctgggcgtggtggttcacacctgtaggccagctactcaggaggctgaggcaggaggatcgctggagcccaggagttcaacgctgcagtgagctatgatcacacctctgcactctaacctgggcaatagagcaagactcccatctcaaaaaactaaaattaaaaataaataaatt

SEQ ID NO: 424 - DNA, 380 bp, Homo sapiens
acaatttaatttagaatatactaaaaacaacaaagatagttgaagttcattcccacctggttttacactcataggccatagcgtgtcatgcatctgacactgaattcctctaagaagatgaagtcagtgcctcctccttattgcactctgcttataattgtggttatgtgtaccttaatcaaatgacagatgaaatgtatcttgaaagcagggcttatttctaatttacttgaccagctttcagtctctttacagtaccatgcaaagtaccatgaatgcttgcaaatgaattttaattactcagaacatggaagtgagatgtcagcctgaccaaatttacatacccttataaccgtgttggcaatctgtgctttacttac

SEQ ID NO: 425 - DNA, 608 bp, Homo sapiens
agccaactgctcctgcgccgggcggggtcgtcgccgccagcggctccgagcgccggaagggccaggtcgcagggctcctggagctgcaggcggcgggaggggctacaaatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagtacagagaagagcgagagattcatgccaccgcttactataaagtggacgacccagtgtggaacttctgcggg

SEQ ID NO: 426 - DNA, 451 bp, Homo sapiens
ctatcacagagttactccacagtgtaaaatcaggtatgtgtatcagcagttatgcattttcatcgaagatcatgaattcacccattcattaaaaaaacctatctatgtaaccagagaagacaaagacctgcacagaaagatccaccggatcattcagcaggactgccagaaaccaaatcacatggagaagggctgtcacttcctgcacatcttggcctgtgctcgcctgagcatccgcccgggcctgagcgaggctgtgctgcagcaagttctggagctcctggaggaccactactacacagcgttctgagcagagacacgcagaccagctgaggaggacaaagataaggtggcattcacccccaggctctgactttcagcatcatgcaggggcttatctgtctggaggcagttacctcataataaactataaaatatagtcatcttggga

SEQ ID NO: 427 - DNA, 365 bp, Homo sapiens
agccaactgctcctgcgccgggcggggtcgtcgccgccagcggctccgagcgccggaagggccaggtcgcagggctcctggagctgcaggcggcgggaggggctacaaatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatcctctacagttatggagtggatgacagcactggagtttt

SEQ ID NO: 428 - DNA, 1418 bp, Homo sapiens
agccaactgctcctgcgccgggcggggtcgtcgccgccagcggctccgagcgccggaagggccaggtcgcagggctcctggagctgcaggcggcgggaggggctacaaatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagaaaacaaagatagagatcggggacacgatccgagtcagaggcagtatccgcacatacagagaagagcgagagattcatgccaccgcttactataaagtggacgacccagtgtggaacattcaaattgcaaggatgcttgagctgcccactatctacaggaaagtttatgaccagccttttcacagctcagccctagagaaagaagaggcactaagcaatccaggcgccctggacctccccagtctcacgagtttgctgagtgaaaaagccaaagaattcctcatggagaacagagtgcagagcttttaccagcaggagctggaaatggtggagtctttgctgtcccttgccaatcagcctgtgattcacagtgcctgctccgaccaagtgaattttaagaaggacaccacttccaaggcaattcatagtatatttaagaatgctatacaactgctgcaggaaaaaggacttgttttccagaaagatgatggttttgataacctatactatgtaaccagagaagacaaagacctgcacagaaagatccaccggatcattcagcaggactgccagaaaccaaatcacatggagaagggctgtcacttcctgcacatcttggcctgtgctcgcctgagcatccgcccgggcctgagcgaggctgtgctgcagcaagttctggagctcctggaggaccagagtgacattgtcagcacaatggagcactactacacagcgttctgagcagagacacgcagaccagctgaggaggacaaagataaggtggcattcacccccaggctctgactttcagcatcatgcaggggcttatctgtctggaggcagttacctcataataaactataaaatatagtcatcttggga

SEQ ID NO: 429 - DNA, 1422 bp, Homo sapiens
cctgcgttcacccctcctggagtcctggacgcccacctgggagcagcgtcagggccgtgccactttgacccacgttaaacgcattgcatcctcatttctgtgtcccatctagatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagaaaacaaagatagagatcggggacacgatccgagtcagaggcagtatccgcacatacagagaagagcgagagattcatgccaccgcttactataaagtggacgacccagtgtggaacattcaaattgcaaggatgcttgagctgcccactatctacaggaaagtttatgaccagccttttcacagctcagccctagagaaagaagaggcactaagcaatccaggcgccctggacctccccagtctcacgagtttgctgagtgaaaaagccaaagaattcctcatggagaacagagtgcagagcttttaccagcaggagctggaaatggtggagtctttgctgtcccttgccaatcagcctgtgattcacagtgcctgctccgaccaagtgaattttaagaaggacaccacttccaaggcaattcatagtatatttaagaatgctatacaactgctgcaggaaaaaggacttgttttccagaaagatgatggttttgataacctatactatgtaaccagagaagacaaagacctgcacagaaagatccaccggatcattcagcaggactgccagaaaccaaatcacatggagaagggctgtcacttcctgcacatcttggcctgtgctcgcctgagcatccgcccgggcctgagcgaggctgtgctgcagcaagttctggagctcctggaggaccagagtgacattgtcagcacaatggagcactactacacagcgttctgagcagagacacgcagaccagctgaggaggacaaagataaggtggcattcacccccaggctctgactttcagcatcatgcaggggcttatctgtctggaggcagttacctcataataaactataaaatatagtcatcttggga

SEQ ID NO: 430 - DNA, 2240 bp, Homo sapiens
agccaactgctcctgcgccgggcggggtcgtcgccgccagcggctccgagcgccggaagggccaggtcgcagggctcctggagctgcaggcggcgggaggggctacaaatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagaaaacaaagatagagatcggggacacgatccgagtcagaggcagtatccgcacatacagagaagagcgagagattcatgccaccgcttactataaagtggacgacccagtgtggaacattcaaattgcaaggatgcttgagctgcccactatctacaggaaagtttatgaccagccttttcacagctcagccctagagaaagaagaggcactaagcaatccaggcgccctggacctccccagtctcacgagtttgctgagtgaaaaagccaaagaattcctcatggagaacagagtgcagagcttttaccagcaggagctggaaatggtggagtctttgctgtcccttgccaatcagcctgtgattcacagtgcctgctccgaccaagtgaattttaagaaggacaccacttccaaggcaattcatagtatatttaagaatgctatacaactgctgcaggaaaaaggacttgttttccagaaagatgatggttttgataacctatactatgtaaccagagaagacaaagacctgcacagaaagatccaccggatcattcagcaggactgccagaaaccaaatcacatggagaagggctgtcacttcctgcacatcttggcctgtgctcgcctgagcatccgcccgggcctgagcgaggctgtgctgcagcaagttctggagctcctggaggaccagagtgacattgtcagcacaatggagcactactacacagcgttctgagcagagacacgcagaccagctgaggaggacaaagataaggtggcattcacccccaggctctgactttcagcatcatgcaggggcttatctgtctggaggcagttacctcataataaactataaaatatagtcatcttgggaatgggatttggcataaatgttgttggctcccttctgtccactatgtccttggtgtacaatgactttgatctcagccatgacacaacaagaaaaccctccctgttgagctcctggctggactgtgcgttgttcgcagagcagaatggggaggaaacagtgttggcagcttaactgatgtgtgtggttggagtctcttccatggcaaagggacaccacagggtagtgaacattcaggaactgaggggcatatggcctgatcacacagttctaagcttttcaaaacttcaggttatcagagaccttcctgtgggcctctcttgctggctaagaaccggtttaggggagtagttctccctggatgagtgcttacagtttctgtggctcagttaccagcagtggggttgagacctgggtcgatgctctttacaggcctgcccagagatgggaataaacagggatccacagcgtgactatgtgtttgtcattttccttttatttccttgggaatcgaaaggtgtcccagtacatttccctgcacttacagaggtgcatgactaaatacattgtccctcgatgcccctgaagatcacggaggcagtcagccaattgcctggcaggtggtagatgttattttcagggttgccgctgagtgtgcaggatgtgctgacaccatccagacaaagactcggtatgtgcccagacaggtgatggagtcatgcttttgctcagaatgacaaggtaaaggaaaaacatctgaggtatgttgtaggcctgttctgacagcaaaatgacaaatccagccagcaaaaataaagtgtggag

SEQ ID NO: 431 - DNA, 1431 bp, Homo sapiens
tctcattcttcttgggcgctggacaagaattcaaccggtgtgtaagccagactcggcccgggcagtctcaaactcctgactccttatataatttctacaaaaattataaagctgtttcccactccccaccccacattcatgtaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagaaaacaaagatagagatcggggacacgatccgagtcagaggcagtatccgcacatacagagaagagcgagagattcatgccaccgcttactataaagtggacgacccagtgtggaacattcaaattgcaaggatgcttgagctgcccactatctacaggaaagtttatgaccagccttttcacagctcagccctagagaaagaagaggcactaagcaatccaggcgccctggacctccccagtctcacgagtttgctgagtgaaaaagccaaagaattcctcatggagaacagagtgcagagcttttaccagcaggagctggaaatggtggagtctttgctgtcccttgccaatcagcctgtgattcacagtgcctgctccgaccaagtgaattttaagaaggacaccacttccaaggcaattcatagtatatttaagaatgctatacaactgctgcaggaaaaaggacttgttttccagaaagatgatggttttgataacctatactatgtaaccagagaagacaaagacctgcacagaaagatccaccggatcattcagcaggactgccagaaaccaaatcacatggagaagggctgtcacttcctgcacatcttggcctgtgctcgcctgagcatccgcccgggcctgagcgaggctgtgctgcagcaagttctggagctcctggaggaccagagtgacattgtcagcacaatggagcactactacacagcgttctgagcagagacacgcagaccagctgaggaggacaaagataaggtggcattcacccccaggctctgactttcagcatcatgcaggggcttatctgtctggaggcagttacctcataataaactataaaatatagtcatcttggga

SEQ ID NO: 432 - DNA, 1452 bp, Homo sapiens
agccaactgctcctgcgccgggcggggtcgtcgccgccagcggctccgagcgccggaagggccaggtcgcagggctcctggagctgcaggcggcgggaggggctacaaatgcttgactcagtgatgcagaacctttcagagttagctggaagccacagccctgcctcttgatgcagcctggatccagccggtgtgaagaggagaccccttccctcttgtggggtttggatcctgtgtttctagcctttgcaaaactctacatcagggatatcctggacatgaaggagtcccgccaggtgccaggtgtatttttgtacaatggacatccaataaaacaggtagatgtcttgggaactgtcattggagtgagagaaagagatgctttctacagttatggagtggatgacagcactggagttataaactgcatctgctggaaaaagttgaatactgagtctgtatcagctgctccaagtgcagcaagagagctcagcttaacctcacaacttaagaagctacaagagaccattgagcagaaaacaaagatagagatcggggacacgatccgagtcagaggcagtatccgcacatacagagaagagcgagagattcatgccaccgcttactataaagtggacgacccagtgtggaacattcaaattgcaaggatgcttgagctgcccactatctacaggaaagtttatgaccagccttttcacagctcagccctagagaaagaagaggcactaagcaatccaggcgccctggacctccccagtctcacgagtttgctgagtgaaaaagccaaagaattcctcatggagaacagagtgcagagcttttaccagcaggagctggaaatggtggagtctttgctgtcccttgccaatcagcctgtgattcacagtgcctgctccgaccaagtgaattttaagaaggacaccacttccaaggcaattcatagtatatttaagaatgctatacaactgctgcaggaaaaaggacttgttttccagaaagatgatggttttgataacctatactatgtaaccagagaagacaaagacctgcacagaaagatccaccggatcattcagcaggactgccagaaaccaaatcacatggagaagggctgtcacttcctgcacatcttggcctgtgctcgcctgagcatccgcccgggcctgagcgaggctgtgctgcagcaagttctggagctcctggaggaccactactacacagcgttctgagcagagacacgcagaccagctgaggaggacaaagataaggtggcattcacccccaggctctgactttcagcatcatgcaggggcttatctgtctggaggcagttacctcataataaactataaaatatagtcatcttgggaatgggatttggcataaatgttgttggctcccttctgtcaaaaataataaaaaaaaaacaaa

SEQ ID NO: 433 - DNA, 239 bp, Homo sapiens
aggttgaagttcagagtccctgagcagtggctccatgtcgccgtggtgacatcaggggcctgagaacaggtgtttctgttttgtttttgtgatcaggtagatcatgcatttctgactttaatgtgcataaagatcatctggggatctggtcagaatgcagatgccaagtcaggtatggagaggacagaggagggcctgacagttgtgtccacactcagccacctacctttttcctgcag

SEQ ID NO: 434 - DNA, 323 bp, Homo sapiens
ggtatggtacagtactgggacatgaacgagcagtttccccacaggaaggggaaatagaaaaacgcccaaaggaagtactgtaggtgagagagacttgagggttgttagagactgcttgaaaagagaatgctgcataggcgtagtttgaagttgagggtcttctgtccagggtaggctggcttgctgtacttggtgctggcaagtacctttaaaaggtattcattgggtattttcacaagcacatttcactcatgcaagttcgacctctggagcatagcaaaaagtgagtgatttcgtcccactgtttgactgagttgatatct

SEQ ID NO: 435 - DNA, 342 bp, Homo sapiens
gtttatttatacttgcattatattccaaagtatggaaatgttgtaatttatttgatattaattgatgagcactttatttccagtttttgttattcagaacactgctacaatgatattgttgctcatctgtcttttgtacaattatttaagaccccctatcctctcccttcaacctattgctcccctttaaatatgagaaaaggtgagtggttctgtgacaaagtaatgtatatgtttggattttttttttttttaccctttaaatacatggattagttcttataacatgttaatggtttatttttgttatttttaaaatataattttcctgcttccctttgt

SEQ ID NO: 436 - DNA, 442 bp, Homo sapiens
actcctggagggggtgtggggaccgtgggcacctcgggctcacgtagaaggagctgagacttcgtctctactcaggcaagtgcctgggaatatggcttttgtatagggacaggcttgacttcctcctgagtgtgtccacctgaggcaggaggtggcaggttggtgaggagggagaggtggggatggtgcagcctaaggcctggaagagcactggggagccgctgagggacagggtggaatcaggagctagagccctcttggctgcagagtgtacggctgaggccaccagccctgccagactgtggaatcctcacagttcaggaagcccaaggaagattggtgtttgagtcacttaaggaaggcctggtgtgcatggcaggaagaggctcctctccacccaggaaagcctgcagagctcggaccaagcgccagccccaggcgc

SEQ ID NO: 437 - DNA, 479 bp, Homo sapiens
cttggaggtgtgggcacgttaggtatttggggcatcctccagcctggtgtggctggagaatagtgtcttggggaaatgagtcaggggaatcagggaaagggctgaaaatgcactttgggtcagtagttgtttgagccccgtgctgtagggcagtctttttcaaagtgtggtccctgcaccagctacatcagcatcccctgggagcttgctagaatatgaaagcaaattcccaggtcctgccccagtcctactgaatcaaaagctctgaaggtgggtcctagtcactgtgtacagggcccccaagccctgtctgattcccatttatacccaagtttaaggacactgctgttgctagtggtgggctatgagactgaccattaacacaaactttgaagaatgcgtgatcccctgtgtttattagatatgacatttggctgcatttaatggaaatccaaatgcagtcactgaaccaattatag

SEQ ID NO: 438 - DNA, 732 bp, Homo sapiens
gaagtttgattgcacattgctgatttagactctagtttaacatccagagatctcatcatctagcagaactaccccctgcctacctctcaagcccccaaaccatggtgcaccaggttggcccttgtctctaacacaatgagttacgtaatttagttcctatgcaccatcaccctcattgttcctttaccttgaccactatttttccattcccttctttccattcacctctccataatcttcaactaatctctgtgtcaaaatttacctcatggtcagctgctccagaaagcttttctagaaaccatcccatgctgcaaccctgccacaatttagattgtcccctttcatttcttaggtagaagcctatgtatgcatgtatcacatgcttttgctgttgatttattctctccatttagatcagcatttctcagcctcagcactattgacatttggggccagataagataactctttcttgggaaagtagacagctgtcttgtgagctgtaaaatgtttagtctcattcctaacctctactcactggatgtcagtaacctccccagttgtgaccatcagaaatatatctgcacattgtcaaatgttccctggggagcaaaatcaccaatgcataagaaccactaccttagacctatctgttttctaaggagagcctcttgaggtctgtgagacacttcaaaccacagcatggtacataggtcctgcacaccttaa

SEQ ID NO: 439 - DNA, 424 bp, Homo sapiens
atgataacatttgactaccatgtggaaggcactcaaaatgcaggttacatggagtgtgggtcatgaaggccaatgagccccaaagccccattctcaaggagtttacgtctagcagagacacagacaaataaatggccaaatattctagaaaattctataagataaatacccatgactgggatgcttaaagggctatcataattcacaggattcatttctaacttaggtcattcaggaaggcctcttggaggagggatttattaagctagattttataaggttagtaggatttagatgggaggagggcattttgggcaaagggactagcatgagacaaggtctgcttgttagatggtctggatatggctggcacatggtagatagaccagtttggcttcagtgtagaattcatggaagtattatt

SEQ ID NO: 440 - DNA, 402 bp, Homo sapiens
gctagaactttgaggcttacagattctgtttgttgattcctctaaaactaaagtcttaatataaacagatggtggtcaagcaaagattagttttgtttcatagagcatttgttgatcttcgtccatggtaagcaagaaaggaattccttcttgttaagggatacactccagtttctaatagtcctcctcctctttttttccttataaagtatatttccctttctgtactccttccttccttttatattttactgccagagttggttcctagatgtgcagaaagaattgcagtggaattttaacttttatgtggcatttctactttgtaaatgatgtagaaagaggaaggctttttaacttttgctgcttttaaagaatttactgctgtttctgatttatttt

SEQ ID NO: 441 - DNA, 674 bp, Homo sapiens
cgcttgagctcagaagttcaagaccagcttgggcaacatggtgaaaccccatctctacaaaaattagccaggcatggtggcaggagcctgtagtccctagaaatttatgactcttctaggaatcaagattgttgtcccacagcagcctcacacacctggcatagcagtgattaaactcattgggagctatctcaaaaataattgtgagtgaggcttttggtacatagagtagactccaatcagacacataaaacccacagtacattttaggaagctatactaatggcattaacctggattaaaagggactaaatgttaaaagaccctggacccccaactttctatgggcaacaagcaggcatagttgctcaaaagacagtttctagcccaggcatagtagctcatgcctgtaatcgcagcactttgagaggccaaggcgggcggatcatgaagtcaggagttcaagaccagcctggtcaaaatagtgaaaccccatctctactaaaaatacaaaaattagctgggcatggtggtgcatgcctgtagtcccagctacttgggaggctgaggcaggagaatcgcttgaacccgggaggttgaggttgcagcgagctgagatctcgccactgcactccagcttgggcaacagagtgagacttcatctcaaaaaaaaa

SEQ ID NO: 442 - DNA, 347 bp, Homo sapiens
aataataataaataaaataaattaatcattctatgtataactattatgtatcaataaaaaaactttcaaagactagcaagtagattcttttctttacattttaactttctatcattctttctccttccattgttatattcctcagaattgaattttgcttccttactcttgttttctattgtcttcctacctccagccatcatagttcaacactatgtcacctcctgctttttaacaatattacaggcttagggattagtgctgacttcctattagttcattaccctgttaattttaaaaagaaataataatggctgggtatggtggtgcacgcctgtaatcccagc

SEQ ID NO: 443 - DNA, 276 bp, Homo sapiens
ttataacttttcttgcccctattctatttcaagagaatgcagagaccccactccagggaagggaggtgtaaacgtccactgctactgaagttgttagatgaatatttttcaagtcttaaaatgcttcctcagaagtaccagctctgtcatgtttacgaagtttctccacagtgtagtgatgataactaatatctactcaacacttccccagtacaagacacctgttcaatcttcacaaccaccttctgagtaagccctgttatcattccatttaac

SEQ ID NO: 444 - DNA, 406 bp, Homo sapiens
aacactaataaatattttttttcttgcagacagggaattaagatttttcaccattttgttgatattttggctggtataacttatctggaaggaaaacagaaaagggttcttttgaaagtgagtaaatatagtagagatggtagctcaacactgtaatcccagcactttgggaggccgaggcaggcagatcacctgaggtcaggagttcgagaccagcctggccaacatggtgaaacctcatctctactaaaaataacaaaaatgagctgggcgtggtggtgcacgactgtaatcccagctactcgggaggctgaggcaggagaatcgcttgaacccgggaggcagaggttgcagtgagctgcgatggcaccactgcactccagcctgggctacaagagtgagactc

SEQ ID NO: 445 - DNA, 421 bp, Homo sapiens
aaccacattttgagtagcaagcaagattctaaggttccacctatcttggcttttgacatttggattttccttcctctgtcctttggacattgattgggatcaggtctgatgaacttcaaaaaaaaagggcataagatcatctgaggtttgacttcttggtcatcaggttacctacaaacacagcatcacatagtgcattgggtggggccgctgctctgctgagcagctgagtcacaccagattctcagacaggcaccatggctctttgggaggccaaggcagaaggattacttgagcccaggagttcaagaccagcctgggctgcatagtgagaactcgtctctaaaaaaaaaaaaaaaaattaagtaaaattttaaaaaatttaattagatttgctgagggtgaggcctggccaccagta

SEQ ID NO: 446 - DNA, 354 bp, Homo sapiens
tcatataaactctttgatctgcttgaaactttaaagtaacctgcactgttttacacgaagctggcttgattacagctatacttttatgtatgaaatctaaaattcactctgaacattcatcaggccaaagccctctgtacccaccagggactgtgctaggtgccttcatgaacagtgaggaaacagatacagcatcagattcaccccaaggagtcagacatgaggatgcatctccagtgccttggaggccagaagagggaacactcaactttgcggggcatttggggaacaccagagacacaatgagcttggagcaggctcacaaactgcttctcactgtgcctgcccaggaat

SEQ ID NO: 447 - DNA, 270 bp, Homo sapiens
ttttaactttaaagaatgtagcagaagggatgctgtatctgaaaccaaacctaaaagcacggtgaatgaaaggaggagcagattacctcaagggcagaagaaaatccaaaagccacatataaagaggggaatcagacccataattcatagcagagcaactgcacaaccaaactttgtttcaagatattcagtcttcatcacattccttgctaactcttcaaatgacagtattaacagtggagctggattactctgtaaatgctacatact

SEQ ID NO: 448 - DNA, 150 bp, Homo sapiens
agaaaactgttgaattgttttaaaattttagctaatttcaacaaatttaagatagcaaaacaaatgtatgtaatcataaaagtcatttgcatacgctgttaatttgtagccatctcaagaaataagggtaaattaaaattatattaagtc

SEQ ID NO: 449 - DNA, 394 bp, Homo sapiens
atttattaagaactctttgtataccttaatgttttcccggtgaaatcatcttaatttgagcccacattttctttggataagattattacgtaattgctacttactggccactattttctatacatttgttggtcaaacagagtgtctgtctcttccagcctggcacacagatcattccaccaggcagaggctcctggttggctccatggagccataccgtatataccctatgtgccaaaaaggatgaataaagctagactaagcattagctttttactgcagagatgaacgactccacctatcagaggactggattgtttcctcattaggggtggcaaacgatggggcacccttgggctgttttcctatggattggattaaattggataccaga

SEQ ID NO: 450 - DNA, 2917 bp, Homo sapiens
  misc_feature (342)..(342): n is a, c, g, or t
  misc_feature (346)..(346): n is a, c, g, or t
tgatttaacttttattttggggataaatagtagaaaaaagtgaaacagaatgaaggcaggtgttttttattctaatgatggaataatacagagatactggacgatctctagcagttaattattgtgacccatataaaattatacaggtcacagtataattctctattaccgtttttacaccagtaagtcttagataaactaagcatgcttatgaattatgtatacagttagaatgcattatttttacagaggaacaattgcttgtatgtactaacactgttctcttggcttgcctcaagttctactcattattttatataaaatactattaggctgggcacnggtnggctcacgcctataatcccagcactttgggaggtggaggctggcggattacttgaagccaggagttcgagaccagcctggccaaaatggtgaaaccccatctctataaaaatacaaaaattagccaggtgtcatgatacatgcctgtaatcccagcttcttgggaggctgaggcacgggaatcgcttgaacccgggaagcacaggttgcagtgagccaagatcatgccactgcaccccagcctgggtgacagagtgcaacactgtctcacaaaacaaaacaaaaacatcagattctgtttgtgatgcctagttgcttacaacctaaacagtgcaatgccttaaggaaatgaaaaggagccataagtagtcatttatatttttattttgaagtgtgctttttctaaactcccagattgacatgatggactgtaagttagtttctctgtttctgtctttgtgcctgtagagtgtacttggcacttacaaattcccagtatccagaaagatgatctgatgaaatcaaattggatggatcttggcagactgtgacactcaattacagccttcactttcagtcaaaaacggacacttggcaaggaggtgcctggttgtttcactaaatgtcacttgtgtgtgtaatattttaaagctttttccccacaggaaattcgggtcataaaatcctgaaaaataattctaggtgggaaaagcattttaggaaatgagagatgtggtgctgcttcttctctcagagtgctttctcagcaggacactagccctgcctttaagatggggaagttggggcatgtgcctctgctcttactgtctgcagctctgaaggtaggtgctgtcccactcggacaatcgcccaagcagcagtgaccatagttctcttctatgcaagtccccaggagaaggtaaactgtgtggaatggggatgtgttctggttgctgctgaatcccctcttcttaccacagtgcctggcacgttgcacacactcaaataccgtaataatgaacatttattgaaagcagcagttgaagctgaccaatttctggtaccttgtcatgtaaattttagatggtaaggcgcagatgttactttttttgctttttttcttcagcacttgatgaaatttcccaaacatgcagaaatgttgaaagacttgtatagtgaacatctacgacctagaatctgcagtaatattatgttacatttgctttatcacttgatagatgttacttttaatgagacttcaagtttggtttctctaaacaaaatattctaaaataactgaacaactttaatcaatttgtcttaagttctttgggggaacttgggacatttgctttgtaactggaattgcagccctcacgttaagctaattttaaactttgcaaatttgttatgctgaatttcagtcttatttattttgcctgaaggggtattttttgtaatggatttatttgaaggtccttgataaattgtgcagaatattctcgtgttctttttgcacttgataaattatctaatttctgtggtgagaatgtaatttggggcctattttgtttatacaagcttccagaattatgttctcagagggatgaaaaggtgtaatttagcatataggtcactaaattaggagctaagacacattttctcctgactgaccatgggtccaatcagttttgtcttcgtgtccttttccttgtaaagtagaaactagaatttgaaatttaaatattaaataatgggtaacattcattaatgtatgactctattaagaaagacactgtgaatccagggaggattctcataattctgtaaactgtatgacaagctgtggaatgaaatctgacttttgaaaattgaaagacatccagtggtcttatcacaaagcctgcttttcctcagaacttaactattgccatggaatttgtaagcagttatcctaatccatctggactctgaaaatgcatcctttatgagagggagtgaatgcaaagataagggtggggaaacactaatcatgaaaagaatgaaaatcagtgttcagttttaagagcaggttgtattgaaggaagggattaaaggaattatccagatttgaggtggcacatcttccaccactccctgcaccatcagcatgcacggagcgcataaaacaagccctgctcctaatggcagtgaaacctcggatggcctccatcaggtcaatacaactgaattgctgggctgacttaagattgaaggactccattttagtaagtagagaagtgtgacctttctcaacccaggttgtgaatgtggattcacacttatctcaaaaaggcacctggagttttaactttatgtcatgtctcagtactggttgcaaggtatgaccaaaagtgttccttgaatggcacctttttgaatattaatttagaagaaaacatgccagactgacatacttaccccctccgcactgttactacttccttaccagccctatgtactgcatcaatgtctacaagaaagcactcttcattaaaatgaaatatatatattaaaatatgatagtccaagt

SEQ ID NO: 451 - DNA, 217 bp, Homo sapiens
gcacgagcaaggaacacttttggtcataccttgcaaccagtactgagacatgacacctttttgaatattaatttagaagaaaacatgccagactgacatacttaccccctccgcactgttactacttccttaccagccctatgtactgcatcaatgtctacaagaaagcactcttcattaaaatgaaatatatatattaaaatatgatagtccaagt

SEQ ID NO: 452 - DNA, 458 bp, Homo sapiens
atgttgattctactgtgtatccgttctctgtaacaaaccttagtcatggtacaactacatgtttagtctgtaagaccttctagcaagtcaaacctgtcagtggtcctggggacccgtttaacatacccttcaagacaccagtttttgcatctgtaaaatttcggtaataacccatattactccaggattgttttgaagaggacctgaagtgtacttaaagtttttaacatgggccctaattgccatcattgtttcataaagtttttcattacttacattgttttgtgtaattacgattttataaaatgaaaacagtgacagtttgtatactgattcttggctgcacatctgatctgtgtaagtgatttacctgggtcatagatcacattcagctttacttgataatgaaaagttgtttttcgataattaaaagttgttttccaaaacagtaaaaaaaa

SEQ ID NO: 453 - DNA, 442 bp, Homo sapiens
acagtagccattttaggacataacaaggttgttctcctcattacttacaccgtaagcaagatattaaagactacacaagaagggcaacaggccaaaggtgattaatacgccataacagaattgtcttataccttctttttcatacctatttagaatccaatctgacactatttggatttctgtgaagtggcttttggtacatattcttgatttttctaccttgatatttaactttatcgccattcttcatatctagtgtagtaacatctgagtttgataacactccatacattggttcattgcattgatgatactgtgagaattgcctcttgggagaaaggcaggcaggagaatttaagtcacccatatgacaagtagaatctggctagtgaacacagctgaactgtaagcctggcctagttacattttgagggattatatt

SEQ ID NO: 454 - DNA, 446 bp, Homo sapiens
ctgtatatgatgagcatattctttgtcacttggttggaaaacagttacgatcaattatattttacttaacatactggaagctagtggaatggaaaccactctcagttggtaagatacaggctacagaagaaggagcttccttgctcatggctttagcagcgtaactaagatgtgatttttaaaaagacattaatggttaaatgcaaactttattttaaattttatatctccatctaattaaaagtgccctgtgctaggaatccgaccacttgagtaagattctcaactctgccacttatgagctctgtaactttgggcaagtcacccaagttctctgattgtgtttcttttgtaaactggaaataataatgcttgccttctattttatattgggttgttaacaggatcaaatgagagaataaatgaaacataattttataaaccat

SEQ ID NO: 455 - DNA, 157 bp, Homo sapiens
ccttgtgcttttattatttttttttaatatgctttttggttaacaacagaagtccctacagttggccctctgtgtctgcaggttctgcatccgtggattcaatcaactgcagatgaaaagttttcagaaaaaatccccccaaaataacaatacaact

SEQ ID NO: 456 - DNA, 433 bp, Homo sapiens
ccactgctaaccatgtatgggacctctctgtggctgtcccaaagcggggagattggaccagactgagcggacagttacagaggctgtgatacactccagatacctgtcaggactgagacccatttccaggagtgttggacactcattgttcagagctgctgccagctcatagctgactcttcctgggaattgtgttcagtggaggggagctgcccaaggttatgccctcttccaggggcagcccatgtctggagacttgtcgatatgggagtatggagaccccaacacccttgcctcaatttgggacatctccaaagaccatcctggctccactgcaccggtgctgtcgtcttgaggcctctgctgcgtctgcatctcagttccacctctcgcctgcccaatccagtagcccttgctcccttatgagtggtgc

SEQ ID NO: 457 - DNA, 440 bp, Homo sapiens
gaaatcaccatccccctgatgatacagaaacctttgactagcgtagccaagggcttactcaacatctgcagtccaatgtctggtgggcagctcacgtttacaaagaactgcagatcttcccccataaagctgctagtcccacagtcttgcccatctaagaaaatgtcaggaacacggaccagaggccctagagtctgacaacgcctcacctgtctgctgtggccatcctggctcaggccaccatcatccctggcttccgaccaagactttctatttccacacgggcccaccccaccctacccatcacagtctgctgtcagacatttagaacctagattagatcaagcacccctctgcttggaaccagtaagtcctctgccagtgaaacccaagtccctgcaacatccaacaaggcagaactcaatccggtgcacacgccc

SEQ ID NO: 458 - DNA, 378 bp, Homo sapiens
cctcctgccccaccctaatcccactttccagaggtaaacctcttctaatcagctgtctttgattataatctttataaccaataaaatgaatttgaaatggaaaccaaattgacctttagccacaagagaatacatacagtggcccttatggttgaatagggcagtggagtacattgaatttaataatactgtggtccaaaggaacagaccaagtagaagaaccattggatatagaaagatactttctatgtaaaagctcacaaatacaagaataaaaatgaaataaaaagtttgaatgaggaaaaaaggaaaacatcattttcatgttgtggtaggcctatagacagtccattaaaagtatagaaatggtattttcct

SEQ ID NO: 459 - DNA, 424 bp, Homo sapiens
atctctaaaggtaagaactctttgcaatttggaggtccagtgttatgtgagggtctctgttccaatcccccaacctgtataggctgaaagctttccctcttccccctcaaacctcagctgtaggcttccagggagagtttgtgtctcagctaatcagatggctaaacacacttaaaaactatttttccattatattatgctaaaagcactagaagtaatttagtttagcatgtattcatgttgtttagacatgtactactaagtatgtattatgtgtgcatgatttttacatatgcgtgtttaccactatccatttaatctataagcttctaagaggtatgaactatttctattcgccatgttttaagtaatacccagcccaatgtgattcaaaagtaaatgtataataaattctatttgatga

SEQ ID NO: 460 - DNA, 407 bp, Homo sapiens
gatcaaaattaggtcactgcctttgagaaatgatcatgatataactttttattttcaaattctccttaagtgtttgcttcttcccatattctaagaagactagctcacacccatgcacaatgaccacagataaatgcacaaactatgaactgtgtaaactttttattttaaaatataatttcatattgcctctgaaataaggcaattgtttaaaaccctagaataatctttaccaactgtttcttaggtaaaaacttattttttgctgtctgttcctacacccaaactgcactccacaaatgggaaagtccatttaggtgcgcatttattcactgttgttttaaataaccatttatcattatagaagtagtaaagtatatttttagaaagttaggaaatccggacca

SEQ ID NO: 461 - DNA, 476 bp, Homo sapiens
ctcccaccttagcattacctgaaggtggtagccagtagttttgtgcatgggtatgaaggcactttaagaaagatgttaatactgacttgtaatatgcaatggtgtaaaaccaattaagctgtgttgcattttgttacaatatttttttaattttgtttagaagaattttgaggcctttcagttaatttttctggaaaagcatcatccatttttgcttttattattgtccactaatgatttgagaggaattgtccaagttacttattgaggcttaataccttaacactttgtttttttccttagtttcacaggaaggttgtaggggatgttcactagtggggataagaaaatgagatgttgaagtggcttggtcccaaaaggtgattaggaaagaaaaataatagtagttaagaatcttaagccaagaaatggattctttctagtatcttctctttaataatcagtactatgccaaa

SEQ ID NO: 462 - DNA, 6113 bp, Homo sapiens
  misc_feature (5322)..(5322): n is a, c, g, or t
  misc_feature (5366)..(5366): n is a, c, g, or t
  misc_feature (5468)..(5468): n is a, c, g, or t
gggaaggaaatgaagagcaaagtggacacgattgtgaacttcacccaccagcacttcacctcccagttcgaggtcactgtctgggcacccaggctccccctgcagattgagatctcagacaccgagctgagccagatcaagggctggaggatcccggttgctgccaacagaaggcctacccgggaaagcgatgacgaggacgatgaggagaagaagggacgaggctgctccctgcagtaccagcacgccacagtgcgtgtcctcacccagtttgtggccgagtcacctgacttagggcagctgacctacatgctgggccccgactggcagtttgacatcactgaccttgtgaccgagttcatgaaggtggaggagccgaaaatcgctcagttacaggacggcaggaccctggctggtcgggagccgggaataaccacggtgcaggtcctctcgccgttgtctgactccatcctggctgagaagacggtgattgtcctggatgaccgagtcaccatcgcggagctgggagtgcagctcgtagctggcatgtctctctccctgcagccacaccgagcagacaaaagggccatcgtctccacagctgctgccctggatgttcttcagtccccacagcaggaagcaatagtaagttcttggattttgttcagtgatggttcggtgacacctttagacatttacgatcctaaggattattctgttactgtctcatcattggatgaaatggtggtgtctgtccaggcaaaccttgagtccaaatggccaattgtggttgcagagggtgaaggacaagggcctttgattaagttagaaatgatgataagtgaaccttgtcagaagaccaagaggaagagtgttcttgccgtgggtaaaggaaatgtcaaggtcaaattcgaaccaagtagtgatgagcaccaaggaggcagcaatgatattgagggcataaatcgggaatataaagaccacctcagtaattccatagagcgcgaaggaaaccaggagagagcagtccaggaatggttccaccgtggcacacctgttggccaagaggaaagtaccaacaaaagcacaaccccccagtctcccatggaagggaagaataagttactcaaaagtggtggtccagatgcctttacaagcttccccactcaagggaagtcaccggaccccaataatcctagtgacctcacagtgacctcaagggggctaacggacttggagattggcatgtatgccttgctctgcgtcttctgtctggccattctggtcttcttgatcaactgcgtggcgtttgcctggaaatacagacacaaaaggtttgctgtgagtgagcagggcaacatcccccattcccacgactgggtctggcttgggaatgaagtggaacttttggagaaccctgttgacattacactcccatcagaggagtgcacaaccatgatagacaggggcctgcagttcgaggagaggaacttccttctgaatggcagttcccagaagacttttcatagtcaactactcagaccctctgactatgtctatgagaaagaaattaaaaatgaacctatgaattcttcgggcccaaagaggaagagagtcaagttcacttcctacaccaccatcctcccagaggacggcggcccatacaccaactccatcctgtttgacagcgatgataacatcaagtgggtctgccaagatatggggctgggggattcacaggactttagagactatatggaaagtctgcaagaccagatgtaaactcctttcttatgtttgtattcacctttatgccttctgttttttgaatgctggagcagtgagtttgatcagcaataggggatgatttaacaaagtttgatttgtggaggtctggtgggattcatttctaagcaggtaaaagaggtttggagagctatagaagctgggttttaagtttggaaatgcctctaaaacagccacatgtggggactggagaaattctaagacaacagttttatggactgcctggtacgagctcagtgcaaatgtattaaacctgaccccacagacattgttagtcatctcgtgacaaatggccatgtggaattagaaaagatttgggtgttgatttttctatttctagaccttttaaagcacagtggacacttattgccccttggcctgagtttagacatacatgaaagatgactgaatgtagctatcctgatttgtcatgagcgctgctcattatttttatatacatttgcacctgcacctgttcctttgacctctggaattctttttgaaacatgaagagaagaaatttcagtcttttccttgagctctgtttgatttacacatgagttttcttccctgggatttgccatgccatgttatttcctgggtctccatgcaggatgtcaggtttttccagttttctgcacttcatcatctagggatggtatccaagaagcttattctcactttgttttttccttccttttgttgttgaactttcttgtataacactgggacaaagggttttacttaaaatgttaatatacagtgagggagggccatctctttactgttttctatgtgaagtttcaaacatttggaaaaaagttgtcaatcacaaacatttatttttattctctgcttgttgaaaactcatggggaactcctggagtgcatttctgagggtaaaaaggccccaacatagctgtatttatacaagtgctttgtggccaacacaatttactatccaaactgaagtcttaaagtagaattgacctacacagaaaggaaattgcctaggcaatagatgcagattacactttccattttaccagaacaaaagtttttttttttttaaataagtagaatgacagttcaagttagcaatatatagaaatccatccatacaatgaccaaaataaataaataaataaaactcaatcatgactttggcagagataaaacattgacaagggtgtgcatttgtggagagaagcagtgggtttccccccaaaatccatacaaataaatgactattccagaactcaagaagcagctattatagaaaaaaaaattaaaaaccacagctattgaaaaatcaaaacggcaagagaaaaaaagaaacaactcctgcataatgtttaaataaaaatgttattttaatagcatcatgaatggtcttaaggcaaaaatttcagattagcaaaatgtgatgacatatttattaagattgtattattggaaatgtagacactggactagtatgcctcattatgagctttactgagccatttgcatctctaagaaatatgattttaaaggcccaaagtaggaaggatctgcagggggtcacctgaagcagtgccctgactccaaatggctgataactgagctaatccaaggagaggcgttcagttgttctcttattatagatttccttgggtgggaacatgacaaccccgcctcctctagccatgacgtggcagccaaaaagttcttcctgtatctctggcccacaggactgtagtgtgtttgggaacagtgctgaaattgcaagtgatgtaggcctgacctccagagcccagcgttcagttagttgtataaaatggggcttaggaaccgaagctgatgaagttccaaaagtagttcagtttgatgggataaggaagcaaggagagccaggcattagctgcaaaaggagcttgcagagagatggctgacactttatgggaagattcctcagtcagccaaaagcttttcaaagagtttggtgcagaggtagctcagagccaaccatccaggaccgaagaaagctcatgtgctgattgacacatagctatccaggtgagtcggctccttctatgaggcttttcaatcgtctctccctttggatctctggcattccagaaagactgggaattcatttctgaaaatgatgaacctccgctgaaacggggaggaaatctcttacacacatacagcagggtcctgcccactggtaaagtgagacgttgggtagggggtgtaactggggaggaggtgaaggaaattatccctgccatggggagtgttattcaggaacataaaaattagagcattccctctgatggcagtgcttgacggggtgcagggaacaaactggggagcgttcaaacatgccagtggtttctcagcagggctggaaactggccacagtcctgaagatgcttcttgtgacaacttagagtcactgggagtcacacagctcctgtgtagccgcctttgctcctctgtgttaaaacccagtcagttcaaaataacaatcaaatggaaggccatgggggaagggttccttccaccatataacccacacccagatgtatataaacgcatatacatacatatacctgtgtgtgtgtgtgtgtgtgtgtgtgtgtgtgaatactgaagagccagacaacaaactatttagtaagaatcaacagtgactgtcaattgttctcagatttggcatggatactatttctcatgaaataatgtcattaaagtatttcctcctctaaatatttcctgaagatcataaaccatgggttatagcaccttgttttccagctagtcaatatacaactattaggtgctgtgccccaaaatatctaaaatgggggtaaagatataaactattaagccatgaaatctaattttctggggaccatgcatttgcctggattttccaggattttatggctgatagacccaaattattagtcttgataaacaacctgaaccaaacatttataaagtcccttcctctcccatgggaatggaatgctcagactcctgctgagggagacaccagcaagcctcttgagaaggcaccagacagtgaactctgtggtcacatgaagggaggttcagatgctagacgaccagcgtatgacctggaaccattgaggattgcaaccgctgcctccagggtccagatgtgctgcagtagagggcagagcacaggaatcaagaagcagctgccacaccaaagaactgatgcttaaacacacaggtgtgttgcatttgagagaaggcaagaagaaaagacaatagaaggttaccctggaaaaacaacacctagcaaacctcagaatactccatgtgtcccaagagaaggaataattgtctttctagctgttatatattgcacactggccaggataaattcccagactataataatcctgactatgtagacggaagtttctatttataaagtcatgcagggggaaagttgattaatttttgtcccattgccacatctgtagactaagtaanttttaacttgctaacttttagaatgtccacctttgtgcattttngtagcattcttgtttcattattttagaaaggggtcttcccattactgggatgtcggggccctgtcagagaactattattaaggctctgtgagggaactgttnagtctcacagcaaggaccacagagcgtggtttcatctgaaccctacaagtcagggacaccagtgtgttttctactcgagttacctaaaaatggtctcaattttccatttcattctctgtaaatgacacaatagatggtttatagactcagcagccctcaccttttattaaaattatatatgtgtgatgtaatgcatatcacctgtcatgtaaagggacggtatggatggtggaaaagttatgctaaaatatggattgcagatatttttgtatgtaatataggcaatataatgaaacaccgagttttttaaagtgaaagcatgcaaaatcgtagcttttaaatgtacagacatcccactcaaaaatatctaaactgatagtgggaaaaacatttgagacctagtaacatcatgaaatgcactgaatttggaattctggcctagaaaggctgtggcttatgttgggattgatgatggaatctgccagaacattttcatcttattcttcttgacttttggatttttttcttttctttttttctggaaatatttcggaaataaagtgacttcatttttcagcataaaagtatattctaaccacagggtaacacatcgtttttaacatgaaaataaacatttaaacattc

SEQ ID NO: 463 - DNA, 685 bp, Homo sapiens
gggaaggaaatgaagagcaaagtggacacgattgtgaacttcacccaccagcacttcacctcccagttcgaggtcactgtctgggcacccaggctccccctgcagattgagatctcagacaccgagctgagccagatcaagggctggaggatcccggttgctgccaacagaaggcctacccgggaaagcgatgacgaggacgatgaggagaagaagggacgaggctgctccctgcagtaccagcacgccacagtgcgtgtcctcacccagtttgtggccgagtcacctgacttagggcagctgacctacatgctgggccccgactggcagtttgacatcactgaccttgtgaccgagttcatgaaggtggaggagccgaaaatcgctcagttacaggacggcaggaccctggctggtcgggagccgggaataaccacggtgcaggtcctctcgccgttgtctgactccatcctggctgagaagacggtgattgtcctggatgaccgagtcaccatcgcggagctgggagtgcagctcgtagctggcatgtctctctccctgcagccacaccgagcagacaaaagggccatcgtctccacagccaggatggagtcagacaacggagagaggacctgtgggaatcggttaggaaagtgttatgctgttgtccccagtgtggagagag

SEQ ID NO: 464 - DNA, 502 bp, Homo sapiens
agtaggaagtacttataaagtacttctgctatatgtcaaagaacagtggttgtcttgagggaaaacattagtgtgatcattatagttgtgagctgaattaacccctttattcatgtaatatcctttttgtttgaaagaatgactgacaaactggttgttcagactttggtattttgcagcttcaagaacattaataaagtaaaattgttacttcaaagtaacaacttgcaatatttgttccaatgataaaatttgagcttttggcagtggctcatgcctataatcccagcacttagggaggctgaggcgggaggagcacttgagctcaggagtttgagaccagcctgggcagtctctccaaaaagaaaaaaaaaattagccaggcatggtggcatgcaccagctgaggtggaaggagcacttgagcctgggaggccaaggctgcagtgagccatgattgtaccactgcactccagcccaggcaacagagcaagatcttgtca

SEQ ID NO: 465 - DNA, 3872 bp, Homo sapiens
cagggaaggcagtggcaagatggcgtccctggatcgggtgaaggtactggtgttgggagactcaggtgttgggaaatcttcgttagtccatctcctatgccaaaatcaagtgctgggaaatccatcatggactgtgggctgctcagtggatgtcagagttcatgattacaaagaaggaaccccagaagagaagacctactacatagaattatgggatgttggaggctctgtgggcagtgccagcagcgtgaaaagcacaagagcagtattctacaactccgtaaatggtattattttcgtacacgacttaacaaataagaagtcctcccaaaacttgcgtcgttggtcattggaagctctcaacagggatttggtgccaactggagtcttggtgacaaatggggattatgatcaagaacagtttgctgataaccaaataccactgttggtaatagggactaaactggaccagattcatgaaacaaagcgccatgaagttttaactaggactgctttcctggctgaggatttcaatccagaagaaattaatttggactgcacaaatccacggtacttagctgcaggttcttccaatgctgtcaagctcagtaggttttttgataaggtcatagagaagagatactttttaagagaaggtaatcagattccaggctttcctgatcggaaaagatttggggcaggaacattaaagagccttcattatgactgaattacactcatcctttggaagagtgagcaagcagtggcagtttttcacagctcatcttgctgtgttcaattattaccatcacagccttttaacaaaatcatcttaaaatgctacccttcagccttaccctttaatggaaaaatgaaaggaagtgacaatacgggaggtccaaactttgtccctgttctctgtgttccttacctttctgtccctgtgtatagattatgtaaaagccttgtgtaaatatgagatgttgtcaaaatgatgcagtaaatgagcaatgacagtgtactgcagagaaaatttactcttgcctagaactggagggtttttatgggtctgtaattttcccacactcattgctgaaagcttaattaagtacttcaaaaacgtatctccattgttttaccttcttgaggggaacggtcttgttaaccagccctgagttgtctaccccaaacaatctctgtcattttcaaagatgcaaaatggtgttatttaattgtctccaccattgtcacacacaggaatgcctaataatagcaacccttgtctccctcttctctcctttgcaaatggctcagtgactggaagaggcggactaatagccagagttaaatataaatacaaattaataatacatagagaacagcaataccagaaaaaaagaattctggtaaaatgatgtgaaaaattgacagctccctcactcttaaggttgctgctatatacagtctaggttttctgtttggaaataggtagggtaaaatctaagacctgcacaagggcagtgagagacatttacagcctcctctctatttgtttttttaaggaaaagtcaactcctgaaatgtcccttagctataatcagaaaactaagaatattattctgtgtcaacaatgtatttatggagagaagtaaaaataagttccacagcaacacatttacatgaattatgaactaggattcttggatttcataatcactccaaagctttttggggatggtgtgtgtgtgtgtgtgtgtccgtaattgttcatcattactttttttaacctatctttttgcttgcttaatcttctctgccccagttcttcctgagtatatgaatttgatttctaaaaacaatttattcaacactctatcacccgtattctctctctggctctgctgcaggtctctgcactcctgattttgctccatacttttaaataacaataataaatatacagttttcatttctcatttaaaaaataggtggaaaacaccaaattcactttctgttccattttaattaggtttcagaagtatcttggaaatcaaggtatgctgcaagaggatattaaaataagaatgttagagagtccttttagaaaggcagtcttgggaatttggaaaaggatttttaaagcagctttcatcagctagactgttctccagcctttctttacttcctctttgaaaggacatagccctggtttctttttgacacaaaggaaagctatgcaaatcatgatctgtatgtagaattggtcacaagtatgttgttgcataggctgtacagttgggaagtagaaaccaaatgctacccagagacctaacccaattaagctctttgtatttctccttcaagaaataaatcttccttccttctttcttcctctttcttttaattttaaaaaaattcatcctgatttttttattttctatcttatttaaaaaataaaaataggccaggcgcggtggctcacacctttaatcccaacactttgggaggcgggtggatcacttgatatcaggagtttgagaccagcctggccaacatagggaaaccctgtctctactaaaaatacaaaaattagccaggcctggtggcacgcgcctgtaatcccagctacttgggaggctgaggcaggagaatcacttgaacctgggaggtggaggttgcagtgagtcaagatcgtgtcactgcactccagcctaggtgacagagtgagactccaactaaaagaaaataaataaataaatatataaatatataaataaataataaaagtaaactattgctgatgactccagggtcaatctggaaaaattaacagtattcctcaactccattactttctgcagccaagcttgattccttgaattatagttttctaagaaaaaatagtttttaataatctaaggtaaatttgttgcaattattagcagcagcataataaggctttttgcgcaaatgaatgttattagctagagttattcaaaaaagaatgaagcacaatttttgctaggacttcttgagaactattcataaaaatgcttttagataataaacaagtataaatgtcaaaatatttttttaaaagtataattggccaggtgctggctcacgcctataatcccagcactctaggagactgaggcaggaggatcacttgagctcgggagtttgaggctgcagtgattcatgattgcaccactgccttccagcagcctgatgacagagtgggactccatctctttacatatgtatatcttactctcttgatgggacaagttggtagaaataaagattttttttttctgttgtgatttcggtgtctgaccaattttctgactcattgtgaaggtgaccagatatgaaggcatatatatgactactcctctgtcccttaggtgtataagacttagctggaatccaactaaagatttgggctggtctctccatcttaacgttgatgggattcaggacacataaccccaaaatattgcaccctgttatttgagaaaactgcagaagcaaggtttctcataccttccccttaccccttctcccctgaagcaggccataaaccctaagtgactgttccctgaagtagatcataaaaccttcattccataggtaccctttatcctcacagatacagagacaccaagaagaatctggacaaataggacttgctaagttctccacagtttattaccattagattatgtccttttgtcctctgattatacttctgcataagactgtacataaaaatacacaagttttcctatttcttttttgtcttcatttctgaagattcctgtcatgtaaaacttacagtaaataaatgtgtgtgcttttctcaataa

SEQ ID NO: 466 - DNA, 4024 bp, Homo sapiens
tggtccatgtttgaaggcagtggcatgatggcgtccctggaatcgggtgaggtaccggtgttgggagactacagagataacaaaagctgcgataagaaccctcaaggaacttaaaattaagggagtggttccaagatgaccaattaggaacagctccagtctacagctcccagcgtgagcgacgcagaagacaggtgatttctgcatttccaacgaggtgttgggaaatcttcgttagtccatctcctatgccaaaatcaagtgctgggaaatccatcatggactgtgggctgctcagtggatgtcagagttcatgattacaaagaaggaaccccagaagagaagacctactacatagaattatgggatgttggaggctctgtgggcagtgccagcagcgtgaaaagcacaagagcagtattctacaactccgtaaatggtattattttcgtacacgacttaacaaataagaagtcctcccaaaacttgcgtcgttggtcattggaagctctcaacagggatttggtgccaactggagtcttggtgacaaatggggattatgatcaagaacagtttgctgataaccaaataccactgttggtaatagggactaaactggaccagattcatgaaacaaagcgccatgaagttttaactaggactgctttcctggctgaggatttcaatccagaagaaattaatttggactgcacaaatccacggtacttagctgcaggttcttccaatgctgtcaagctcagtaggttttttgataaggtcatagagaagagatactttttaagagaaggtaatcagattccaggctttcctgatcggaaaagatttggggcaggaacattaaagagccttcattatgactgaattacactcatcctttggaagagtgagcaagcagtggcagtttttcacagctcatcttgctgtgttcaattattaccatcacagccttttaacaaaatcatcttaaaatgctacccttcagccttaccctttaatggaaaaatgaaaggaagtgacaatacgggaggtccaaactttgtccctgttctctgtgttccttacctttctgtccctgtgtatagattatgtaaaagccttgtgtaaatatgagatgttgtcaaaatgatgcagtaaatgagcaatgacagtgtactgcagagaaaatttactcttgcctagaactggagggtttttatgggtctgtaattttcccacactcattgctgaaagcttaattaagtacttcaaaaacgtatctccattgttttaccttcttgaggggaacggtcttgttaaccagccctgagttgtctaccccaaacaatctctgtcattttcaaagatgcaaaatggtgttatttaattgtctccaccattgtcacacacaggaatgcctaataatagcaacccttgtctccctcttctctcctttgcaaatggctcagtgactggaagaggcggactaatagccagagttaaatataaatacaaattaataatacatagagaacagcaataccagaaaaaaagaattctggtaaaatgatgtgaaaaattgacagctccctcactcttaaggttgctgctatatacagtctaggttttctgtttggaaataggtagggtaaaatctaagacctgcacaagggcagtgagagacatttacagcctcctctctatttgtttttttaaggaaaagtcaactcctgaaatgtcccttagctataatcagaaaactaagaatattattctgtgtcaacaatgtatttatggagagaagtaaaaataagttccacagcaacacatttacatgaattatgaactaggattcttggatttcataatcactccaaagctttttggggatggtgtgtgtgtgtgtgtgtgtccgtaattgttcatcattactttttttaacctatctttttgcttgcttaatcttctctgccccagttcttcctgagtatatgaatttgatttctaaaaacaatttattcaacactctatcacccgtattctctctctggctctgctgcaggtctctgcactcctgattttgctccatacttttaaataacaataataaatatacagttttcatttctcatttaaaaaataggtggaaaacaccaaattcactttctgttccattttaattaggtttcagaagtatcttggaaatcaaggtatgctgcaagaggatattaaaataagaatgttagagagtccttttagaaaggcagtcttgggaatttggaaaaggatttttaaagcagctttcatcagctagactgttctccagcctttctttacttcctctttgaaaggacatagccctggtttctttttgacacaaaggaaagctatgcaaatcatgatctgtatgtagaattggtcacaagtatgttgttgcataggctgtacagttgggaagtagaaaccaaatgctacccagagacctaacccaattaagctctttgtatttctccttcaagaaataaatcttccttccttctttcttcctctttcttttaattttaaaaaaattcatcctgatttttttattttctatcttatttaaaaaataaaaataggccaggcgcggtggctcacacctttaatcccaacactttgggaggcgggtggatcacttgatatcaggagtttgagaccagcctggccaacatagggaaaccctgtctctactaaaaatacaaaaattagccaggcctggtggcacgcgcctgtaatcccagctacttgggaggctgaggcaggagaatcacttgaacctgggaggtggaggttgcagtgagtcaagatcgtgtcactgcactccagcctaggtgacagagtgagactccaactaaaagaaaataaataaataaatatataaatatataaataaataataaaagtaaactattgctgatgactccagggtcaatctggaaaaattaacagtattcctcaactccattactttctgcagccaagcttgattccttgaattatagttttctaagaaaaaatagtttttaataatctaaggtaaatttgttgcaattattagcagcagcataataaggctttttgcgcaaatgaatgttattagctagagttattcaaaaaagaatgaagcacaatttttgctaggacttcttgagaactattcataaaaatgcttttagataataaacaagtataaatgtcaaaatatttttttaaaagtataattggccaggtgctggctcacgcctataatcccagcactctaggagactgaggcaggaggatcacttgagctcgggagtttgaggctgcagtgattcatgattgcaccactgccttccagcagcctgatgacagagtgggactccatctctttacatatgtatatcttactctcttgatgggacaagttggtagaaataaagattttttttttctgttgtgatttcggtgtctgaccaattttctgactcattgtgaaggtgaccagatatgaaggcatatatatgactactcctctgtcccttaggtgtataagacttagctggaatccaactaaagatttgggctggtctctccatcttaacgttgatgggattcaggacacataaccccaaaatattgcaccctgttatttgagaaaactgcagaagcaaggtttctcataccttccccttaccccttctcccctgaagcaggccataaaccctaagtgactgttccctgaagtagatcataaaaccttcattccataggtaccctttatcctcacagatacagagacaccaagaagaatctggacaaataggacttgctaagttctccacagtttattaccattagattatgtccttttgtcctctgattatacttctgcataagactgtacataaaaatacacaagttttcctatttcttttttgtcttcatttctgaagattcctgtcatgtaaaacttacagtaaataaatgtgtgtgcttttctcaataa

SEQ ID NO: 467 - DNA, 3312 bp, Homo sapiens
cagggaaggcagtggcaagatggcgtccctggatcgggtgaaggtactggtgttgggagactcaggtgttgggaaatcttcgttagtccatctcctatgccaaaatcaagtgctgggaaatccatcatggactgtgggctgctcagtggatgtcagagttcatgattacaaagaaggaaccccagaagagaagacctactacatagaattatgggatgttggaggctctgtgggcagtgccagcagcgtgaaaagcacaagagcagtattctacaactccgtaaatggtattattttcgtacacgacttaacaaataagaagtcctcccaaaacttgcgtcgttggtcattggaagctctcaacagggatttggtgccaactggagtcttggtgacaaatggggattatgatcaagaacagtttgctgataaccaaataccactgttggtaatagggactaaactggaccagattcatgaaacaaagcgccatgaagttttaactaggactgctttcctggctgaggatttcaatccagaagaaattaatttggactgcacaaatccacggtacttagctgcaggttcttccaatgctgtcaagctcagtaggttttttgataaggtcatagagaagagatactttttaagagaaggtaatcagattccaggctttcctgatcggaaaagatttggggcaggaacattaaagagccttcattatgactgaattacactcatcctttggaagagtgagcaagcagtggcagtttttcacagctcatcttgctgtgttcaattattaccatcacagccttttaacaaaatcatcttaaaatgctacccttcagccttaccctttaatggaaaaatgaaaggaagtgacaatacgggaggtccaaactttgtccctgttctctgtgttccttacctttctgtccctgtgtatagattatgtaaaagccttgtgtaaatatgagatgttgtcaaaatgatgcagtaaatgagcaatgacagtgtactgcagagaaaatttactcttgcctagaactggagggtttttatgggtctgtaattttcccacactcattgctgaaagcttaattaagtacttcaaaaacgtatctccattgttttaccttcttgaggggaacggtcttgttaaccagccctgagttgtctaccccaaacaatctctgtcattttcaaagatgcaaaatggtgttatttaattgtctccaccattgtcacacacaggaatgcctaataatagcaacccttgtctccctcttctctcctttgcaaatggctcagtgactggaagaggcggactaatagccagagttaaatataaatacaaattaataatacatagagaacagcaataccagaaaaaaagaattctggtaaaatgatgtgaaaaattgacagctccctcactcttaaggttgctgctatatacagtctaggttttctgtttggaaataggtagggtaaaatctaagacctgcacaagggcagtgagagacatttacagcctcctctctatttgtttttttaaggaaaagtcaactcctgaaatgtcccttagctataatcagaaaactaagaatattattctgtgtcaacaatgtatttatggagagaagtaaaaataagttccacagcaacacatttacatgaattatgaactaggattcttggatttcataatcactccaaagctttttggggatggtgtgtgtgtgtgtgtgtgtccgtaattgttcatcattactttttttaacctatctttttgcttgcttaatcttctctgccccagttcttcctgagtatatgaatttgatttctaaaaacaatttattcaacactctatcacccgtattctctctctggctctgctgcaggtctctgcactcctgattttgctccatacttttaaataacaataataaatatacagttttcatttctcatttaaaaaataggtggaaaacaccaaattcactttctgttccattttaattaggtttcagaagtatcttggaaatcaaggtatgctgcaagaggatattaaaataagaatgttagagagtccttttagaaaggcagtcttgggaatttggaaaaggatttttaaagcagctttcatcagctagactgttctccagcctttctttacttcctctttgaaaggacatagccctggtttctttttgacacaaaggaaagctatgcaaatcatgatctgtatgtagaattggtcacaagtatgttgttgcataggctgtacagttgggaagtagaaaccaaatgctacccagagacctaacccaattaagctctttgtatttctccttcaagaaataaatcttccttccttctttcttcctctttcttttaattttaaaaaaattcatcctgatttttttattttctatcttatttaaaaaataaaaataggccaggcgcggtggctcacacctttaatcccaacactttgggaggcgggtggatcacttgatatcaggagtttgagaccagcctggccaacatagggaaaccctgtctctactaaaaatacaaaaattagccaggcctggtggcacgcgcctgtaatcccagctacttgggaggctgaggcaggagaatcatgccttccagcagcctgatgacagagtgggactccatctctttacatatgtatatcttactctcttgatgggacaagttggtagaaataaagattttttttttctgttgtgatttcggtgtctgaccaattttctgactcattgtgaaggtgaccagatatgaaggcatatatatgactactcctctgtcccttaggtgtataagacttagctggaatccaactaaagatttgggctggtctctccatcttaacgttgatgggattcaggacacataaccccaaaatattgcaccctgttatttgagaaaactgcagaagcaaggtttctcataccttccccttaccccttctcccctgaagcaggccataaaccctaagtgactgttccctgaagtagatcataaaaccttcattccataggtaccctttatcctcacagatacagagacaccaagaagaatctggacaaataggacttgctaagttctccacagtttattaccattagattatgtccttttgtcctctgattatacttctgcataagactgtacataaaaatacacaagttttcctatttcttttttgtcttcatttctgaagattcctgtcatgtaaaacttacagtaaataaatgtgtgtgcttttctcaataa

SEQ ID NO: 468 - DNA, 2461 bp, Homo sapiens
tgcttactcttctctgccccagttcttcctgagttgaatttgatttctaaaaacaatttattcaacactctatcacccgtattctctctctgggctctgcacaagggcagtgagagacatttacagcctcctctctatttgtttttttaaggaaaagtcaactcctgaaatgtcccttagctataatcagaaaactaagaatattattctgtgtcaacaatgtatttatggagagaagtaaaaataagttccacagcaacacatttacatgaattatgaactaggattcttggatttcataatcactccaaagctttttggggatggtgtgtgtgtgtgtgtgtgtccgtaattgttcatcattactttttttaacctatctttttgcttgcttaatcttctctgccccagttcttcctgagtatatgaatttgatttctaaaaacaatttattcaacactctatcacccgtattctctctctggctctgctgcaggtctctgcactcctgattttgctccatacttttaaataacaataataaatatacagttttcatttctcatttaaaaaataggtggaaaacaccaaattcactttctgttccattttaattaggtttcagaagtatcttggaaatcaaggtatgctgcaagaggatattaaaataagaatgttagagagtccttttagaaaggcagtcttgggaatttggaaaaggatttttaaagcagctttcatcagctagactgttctccagcctttctttacttcctctttgaaaggacatagccctggtttctttttgacacaaaggaaagctatgcaaatcatgatctgtatgtagaattggtcacaagtatgttgttgcataggctgtacagttgggaagtagaaaccaaatgctacccagagacctaacccaattaagctctttgtatttctccttcaagaaataaatcttccttccttctttcttcctctttcttttaattttaaaaaaattcatcctgatttttttattttctatcttatttaaaaaataaaaataggccaggcgcggtggctcacacctttaatcccaacactttgggaggcgggtggatcacttgatatcaggagtttgagaccagcctggccaacatagggaaaccctgtctctactaaaaatacaaaaattagccaggcctggtggcacgcgcctgtaatcccagctacttgggaggctgaggcaggagaatcacttgaacctgggaggtggaggttgcagtgagtcaagatcgtgtcactgcactccagcctaggtgacagagtgagactccaactaaaagaaaataaataaataaatatataaatatataaataaataataaaagtaaactattgctgatgactccagggtcaatctggaaaaattaacagtattcctcaactccattactttctgcagccaagcttgattccttgaattatagttttctaagaaaaaatagtttttaataatctaaggtaaatttgttgcaattattagcagcagcataataaggctttttgcgcaaatgaatgttattagctagagttattcaaaaaagaatgaagcacaatttttgctaggacttcttgagaactattcataaaaatgcttttagataataaacaagtataaatgtcaaaatatttttttaaaagtataattggccaggtgctggctcacgcctataatcccagcactctaggagactgaggcaggaggatcacttgagctcgggagtttgaggctgcagtgattcatgattgcaccactgccttccagcagcctgatgacagagtgggactccatctctttacatatgtatatcttactctcttgatgggacaagttggtagaaataaagattttttttttctgttgtgatttcggtgtctgaccaattttctgactcattgtgaaggtgaccagatatgaaggcatatatatgactactcctctgtcccttaggtgtataagacttagctggaatccaactaaagatttgggctggtctctccatcttaacgttgatgggattcaggacacataaccccaaaatattgcaccctgttatttgagaaaactgcagaagcaaggtttctcataccttccccttaccccttctcccctgaagcaggccataaaccctaagtgactgttccctgaagtagatcataaaaccttcattccataggtaccctttatcctcacagatacagagacaccaagaagaatctggacaaataggacttgctaagttctccacagtttattaccattagattatgtccttttgtcctctgattatacttctgcataagactgtacataaaaatacacaagttttcctatttcttttttgtcttcatttctgaagattcctgtcatgtaaaacttacagtaaataaatgtgtgtgcttttctcaataa

SEQ ID NO: 469 - DNA, 321 bp, Homo sapiens
cagggaaggcagtggcaagatggcgtccctggatcgggtgaaggtactggtgttgggagactcaggtgttgggaaatcttcgttagtccatctcctatgccaaaatcaagtgctgggaaatccatcatggactgtgggctgctcagtggatgtcagagttcatgattacaaagaaggaaccccagaagagaagacctactacatagaattatgggatgttggaggctctgtgggcagtgccagcagcaccacgaattcgccgagcagcaccacgaattcagcagcaccacgaattcgccgagcagcaccacgaattcgccg

SEQ ID NO: 470 - DNA, 248 bp, Homo sapiens
cagttagccactttttgcaggtatgtgtgctaagcctttaaaatctttgtttttcacaggtcatagagaagagatactttttaagagaaggtaatcaggttggtatctcttttcttgataaaatagattcttaaattttgataggtgatttccaaatttaagttcagaagtagttttaaaaagttggggaaagccctttataggcacaagcaactgatttccttctatcctgttaaatacaaaaggag

SEQ ID NO: 471 - DNA, 516 bp, Homo sapiens
atgaaaccaaccccaaacacagccaagcagagagatggaaagaactaggaccctaattacaccactgagcagctatagcaaccagttccagagccctctgacttcccgccaaagtgagatgataagatactgtttaatttctctcttttatagccaaacacaccaaaattgacacagagatgtgagccatacctactactgttactgctccatccctagctccaaccacagtgcatggtacatgggtagagagccaacaaacacttgaaggaatgaatgggtgcatattgagtggggatttttccagagggcagacctgggagacaagggctttcaagtgcgtgtgtttgtatttaagggaaatgctcccaggggacaatagcagagtggcagaaatgggacaagggggccagggagccaagaacagagaatcaatcgtctaaacagagccccctgttttttgtttcacctgggagtagcttctacctgatccccaggggaactctgggatgtcag

SEQ ID NO: 472 - DNA, 383 bp, Homo sapiens
atattacataagaagagtatgataacagtgggaaagcatggacaaaattctcttcttgttgcagatacatttatttatttatttagaaacattgtcttgctctgtcacccaggctggagtgcaatggggcgatctcagctcgctgcaacctctgcctcccgggttcaaggaattctgcctcagcctccctagtacctgggattacagtacaggtacgtgccaacacgtccagctaacttttgtatttttagtagagatagagtttcaccttgttggtcagtctggtctggaactcttgacctcaggtgatccattcaccttggcctcccaaagtggtgggattacaggtgtgagccaccatgcccagcaggcagatatacctt

SEQ ID NO: 473 - DNA, 386 bp, Homo sapiens
ccactcacacacctacggacacacgctactctgggaggtgatttgcgacttagccaggcccccaaagctgggctcctgtagggagaaagtctgcccaggtccacatccaagccttcatcgtttgtcctccgggttctgggatcctgctggaagaggggagcttctgcaatgggagttgccacaaccctgcagcccccaaccacttccaaaaccttgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaagg

SEQ ID NO: 474 - DNA, 450 bp, Homo sapiens
atttgtttaatcaccatacttatatttgtaggggcttgtggatttcttttaatactttgagttgtaatcaaatactgatttattaatcttgttgctcaaattgttccagcttcgcccattgagcgctctctcatttggcttctgtgtccctttgctagaccccattattgtgggtcttggtgttgtatttgtgttttgagcacttttttttttttgagatggagtctcgctctgttgcccaggctggagtgcagagtgtgagctcagtctcaaaaaaaagaagtcagcacacacacatatacctccttgccctatcagctgagagggcctagaaccaatggcaccccagtatcaacaagcacatctagcaccaagattttggttttcaacaccatgcaccaacgaaaggaaccagggatacttgaagaaatggctgattctaggacttgg

SEQ ID NO: 475 - DNA, 163 bp, Homo sapiens
ttacagctttttggaagcactagacataagcacctgatagtaagcaagtttgccaatgtctcacttttgggtcatttaaggcaaaatctgaattaagtattcattttgccagccctcagaaatgtattttaatcatccaatttaacaaatagatttttagtac

SEQ ID NO: 476 - DNA, 296 bp, Homo sapiens
tatccagacgcgtctaagtggcctcacttagcgtaagtaactctataaatcaggggaactgttagcatccaccgcacaggctggctatcaatctcccccaggtcacagccaaacaggaaggggagaaaaaagagagttaccacccaggggagatttaaaacacacacactgagcaaacgcgcacagaccgcgtgcatgcctgtgcgcgcgcacacacgctcggatgcctgtgtttgtacaatcccgttatattcacatgtgcacatgtggaatctcagagtgctgcgtgtggtcgt

SEQ ID NO: 477 - DNA, 349 bp, Homo sapiens
tctcctgcctcagcctcccaagtagctggaattacaggcgcccaccaccacgcccggctaattttttgtatttttagtagagatggggtttcaccatgttggccaggctggtcacgaactcctgacctcaggtgatccacccgcctcggcctcccaaagtgctgggattacaggcatgagccactgcactcagcctactatgtgatttttaaatgacacagttttagaaaagaacagatttgtgtttgccagagattcatgtcaggctggggacaggagggaggcgggtgtgactatagatggacgacatgagcaatcctgtggtactggagcccttcagcatcatgac

SEQ ID NO: 478 - DNA, 482 bp, Homo sapiens
gaaataaaatacatttgttaacaattattaaaactggatgataagtacatgagcactcattatattattcttgttactttggggtaaatctgaaaattcttcagagccactgaaggctttttcaacaggggaatgaggaatgacagatgaaactgcccttctagcaagtacagccctggagtcggaagactagacagcgggctgccaaggagggtcactgtgatgcaggactgagctatgagagtgtcactgggggcggaggggaggatctgggtgtgaacagtattaaggagatagaagcaaaggagctaaagaagcaggaatcaaggatgaatctccagtttcaggcttacatgaatggctgcatggtggggccattcaacattcaagggaattcagaagaaattaaagttaggagtgaagggagtgatcaattccatttcagacgctttgagtgtgaggtgcctgtggaagactcagag

SEQ ID NO: 479 - DNA, 2286 bp, Homo sapiens
actcagcggttacccgcgctgcctccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggaggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacatacctttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttga

SEQ ID NO: 480 - DNA, 196 bp, Homo sapiens
gaggatccccgtcaatttctacacgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagt

SEQ ID NO: 481 - DNA, 2449 bp, Homo sapiens
actcagcggttacccgcgctgcctccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggaggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacatacctttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttgaaaaaaagagggacggaaccgaaacgacggggcacacagcacacccccaagagagcagcacacgcgcacaacacccagcggggggcttaaaaaaaattccgagggcggcaccacacgcacgcgccagcatgtgagagagggccccccagaagaagacaaagcac

SEQ ID NO: 482 - DNA, 2272 bp, Homo sapiens
actcagcggttacccgcgctgcctccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggaggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacatacctttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaaaaaaaaaaaaaaaaaaaaaaaaaaaaaaaaaaaaaaaaaaaaaaaaaaaaaaaaaaaaaaaaaaaaaaaattccttggttggccgcttgggccaagtcaattttaaattgaagaaggttattgctggcggccgaatttggggctcatttggccatttcgccctattggggggcggtatcacaatcactggccggcggttaacaacggcgggacgggaaaaccccgccggtcccaattttatggcttgtga

SEQ ID NO: 483 - DNA, 2420 bp, Homo sapiens
actcagcggttacccgcgctgcctccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggaggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacatacctttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatccccttttgaaccccaatctggggggcttttctctttagacccccgggggggaaaaacccccccccccttaaccgggggggtgtggtggggttgggtgtggtggtgttgggttgggtggtgttgggggttggtgtgtggggggtgggtgtgatgtgggtcatgttattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttga

SEQ ID NO: 484 - DNA, 2243 bp, Homo sapiens
actcagcggttacccgcgctgcctccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggaggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacatacctttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttga

SEQ ID NO: 485 - DNA, 2030 bp, Homo sapiens
gctagctgaacgactctcttaatctaccaccgctacacatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggaggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacatacctttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttga

SEQ ID NO: 486 - DNA, 2058 bp, Homo sapiens
aagaatgctgagcaactcctcagaagtttggagagcctttcaagtcctaaagatgacaaagatgtgatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggaggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacatacctttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttga

SEQ ID NO: 487 - DNA, 2004 bp, Homo sapiens
atccttaattaaattaatcccccccccccctttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggaggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacatacctttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttga

SEQ ID NO: 488 - DNA, 2380 bp, Homo sapiens
actcagcggttacccgcgctgcctccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagagccagaatgaagaatggggaggttgtctgaggatatcttatgataaagagcagtctaaggctttagtccctttgatccccaacttatttattggaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacatacctttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttga

SEQ ID NO: 489 - DNA, 2033 bp, Homo sapiens
gacacagttaactaaaaactccaagaggaagacatttctataaatgcatgtgacaaaaagcatggaacacaacagtaggcgaagaactgtgggaactcggagggaagaggttttgaattttaccactaagataacttatctttcatatatataattgagtagcagtgatttcataaattgccagcaggtttgcactgggcttgactgctttttgcatgacagcaacggcatctagcacattggtaggtaattagcaggtacttaatgaatgctgaaaacgtccttttgtggtctccaattttgagggcacaaaaccctaaataaccaatggctgtcaactagaatgctactgtgacacgaaattgctttcttgattctctaaaacaagcatgttcttccatgtcaatgtttcacattctcaagactccctggatctgcttaccagagtctcacattttccctccacagaagctgaaaccccacgtagtgttcttgaagaaattggactgacataactctcctcccttgttgatgacttcttgtggcatttcacacactgtagatggtcactcccttcatgtccatgttagctcatggtgtaagatgatgtcttgtcagtattactgttttgctaagccgcttcattcatgcctacacaatttttttttaaaagggaactttagttaattaagtgataagggacttaaatatgaattagaatggtgcagaaagagataccttttctggatattttaaagtttaaaggtcagtttctcttaatctgattatgtgcacatatgaaaatggcacatcatatacatgtaaaatcaggcagtatacatttattaattactgtatttgacaaaggaaactcttaaattataatgtgaaacctggttttatgaaaccaaagactagtgcagcatttcagcatatgtaaaaaaaaaaaaaaagggaattgacatgtcacatatcaaatgaatggaaactttgttgaaactttaaaaagcaaatttactccaaagacttgtattggaaattacatacctttttttttttttttaaaggactacagattatttttaatgactaaattggagtgatacttcttacactaaaaattatttcttaggcattctgaatctgggatgagaaacaggattgtttcacaatagtaagcacataatttttaaggccaaggcacatttgactcctgagatgaattttttgtggtcataatcaaatacttagttgtttttgatgccccaaaataaagtgagaatggtaatttgccaggaattcttcataacagtatcttacaaaaaacgtgttgctctcttcacagtattatgtgtaaagtcattgtttaaagcacgaatgttccctctggggtacttgttaaagctaaatttattttgcttccctccacttagaagtgctgcacactttacagcagcttcctttctttccatggcactgcctagttaacagaagtcttataaaaatttaaaaagacacatttcttacaaaaaagagttgaatgaggtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttga

SEQ ID NO: 490 - DNA, 1263 bp, Homo sapiens
actcagcggttacccgcgctgcctccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagagtttcttttcttcttgaaggatgtttttccagtgaagaggggtttctccctatgaagagtattctcacatttaatagatgccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagt

SEQ ID NO: 491 - DNA, 1020 bp, Homo sapiens
actcagcggttacccgcgctgcctccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagagtttcttttcttcttgaaggatgtttttccagtgaagaggggtttctccctatgaagagtattctcacatttaatagatggtaatttcttacttaagtacagtaatatggatcaatggctataaagaatagtttggcttatcatcaacccttttctttcctaaaagcagtaaaaggtgtgtcagggtataagtggtggaaatgcctgggtggtcacattgagaattgttcctgtagaattgctggtgtagttcatagtaagtctcctggggaggaatggttgcatactccgccctgttt

SEQ ID NO: 492 - DNA, 1182 bp, Homo sapiens
actcagcggttacccgcgctgcctccggtgccgctggcgaccgctgagccgcttcccgcgcgtcgcctagcccgcccctcagctcgccgcagccccggctcctccctcgtccggcccccggggcggggtctgtcagcttgccctcccctctccgcctaagcctgccctatgccagccgggtgtcctccccacagcaccacggcttctcttcctcagcacggcgacaggggcttccccttcgccgccgccgccgccgccggccaagctccgccgcgcccgcggcccgcggccgccatgcagtttatgttgctttttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagt

SEQ ID NO: 493 - DNA, 618 bp, Homo sapiens
ttttcttacaaaaaagagccatctaatgccattttacctcattcaactcttttttgtaagaaatgtgtctttttaaatttttataagacttctgttaactaggcagtgcatggaaagaaaggaagctgctgtaaaatggcattagatggctctatattttttaaagctatgtaattgttcagcgtcacttttctaagtacttatacatatctaaacatgtcttcatggtttatattttcacttatatatgctgggctggattaagctttgttgtgattgtgaccaacattcaggccacgtgagcactgtcttatcacatcgccaattagttgtaataaacgttcaacgtacaaacactggagtgtgtttttatctctttccaaaagtttgtcaaactatgcagagctgctgaaggaagaatttctcatttttttttcagtaaaatgttgaaaattcccctccatttgaatatggtggttgttataagcacacacaagatacatggtggaagatctaaggagtcttcatgtacttcattaaaaaataacatggattccatactgagagcctatctacacatttattttcaatcaataaatgctgcttttaaaaccttga

SEQ ID NO: 494 - DNA, 900 bp, Homo sapiens
atccttaattaaattaatcccccccccccctttagtcgtcagggaaagcttcgactgcaaaaatggtatgtcccactatcagacaaagagaagaaaaagatcacaagagaacttgttcagaccgttttagcacggaaacctaaaatgtgcagcttccttgagtggcgagatctgaagattgtttacaaaagatatgctagtctgtatttttgctgtgctattgaggatcaggacaatgaactaattaccctggaaataattcatcgttatgtggaattacttgacaagtatttcggcagtgtctgtgaactagatatcatctttaattttgagaaggcttattttattttggatgagtttcttttgggaggggaagttcaggaaacatccaagaaaaatgtccttaaagcaattgagcaggctgatctactgcaggagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagt

SEQ ID NO: 495 - DNA, 1060 bp, Homo sapiens
tagacactcaaatctggagagttcgttaaaatctgtcttgaggatttttaaaaaagtaatatcctcagtctcagtcaaattctttggattttttgcttttgtaggtataagtaaacggttaaaaaccttcattgctacttaaaataccagatgagtgactacttttccagtttttattgggaaagatttttctctaggttctttagtttatgtaatacaaatgaactaatgaatttaaatactggtggaaggggaatattctaattgaatttttggtcaactcagtattgaccagatgacttacactgaaaatcttttcataatattagtagtaaatatagtgttttaggattttgtaaaatttctggaggatgtctgtcatcattttgaacactgtatgtagtaaagttagaaaaaaatgaatctaaagtcttgggcattgtttagaagttaaatattcagccttaaaccaaagaatgaaagcaaacagaaacttaagttttagttatctttactgtgagctaaatgttctagaaatctgattgtgtctgtgtcagtttgtatactgtgtgtaagaatatatgcatttcttttgtagccacgtcatgaatattttaatgtccctgtgtactaaatgactactcatcgagtatgcagaatttcacagaggaaatagaatgctgatatacatatgaaagaaaatatcctcagcatggtgatttattgtcttgtataataatagtagaacattttagaactagtacttttatgattgtatttttttcctgttcacattccaaacttttctgttttattttcattctatatgtgatcttgatacagctcattcctttctgcaactgatttaatctcatcttgacaaaatatgacctagaagtgttttgagtaatattaaatcttaaacacatacatattattaatgaaccatctgtgatttatcttataagaggaaaacatgacaatcattaaaatgtttaccaaagaaaatatagctgaagtgctaggtcaaaataagcagtgccataatatatagtgtagt

SEQ ID NO: 496 - DNA, 824 bp, Homo sapiens
ttttttttttttgaaacagtctcgctctgtcactcaggctgaagtgcagtggcgcgatctcagctcactgcaacctctgcctccagggttcaagtgactctcctgcctaagcctcccgagtaactgagactacaggcacccgccaccacaccaagctaatttttgtactttcagtagacagggtttcaccatgttacccaggctggtctcgaactcctgacctcaagtgattcgcccatctcggcctcccaaagtgctgaggtcacaggcatgagccaccatgccaggacaaaacgtaattttagatctcttatgctaagtggccattttcatttaaattttaaatttaagagccaggtctcactaggttacccaggctgcttgcaatcatagcacgctacagcttcaaattcccaggctatagcgatcctcttgccttagcctccccagtagcagggactacaagtgtgcaccacggcactaagctccaatttttatttgttatctgcttctgtctataagctccacgaggacaggagccaactgtttatttcctactcttgcagggttttgtttgaccccttcaacaaatctctccacttgctgcattacaggggtctcttgccttttgccttctacttggatacaagcaataggagcaccaacaggtcagaagatggaaaagaatgaaatccagttatttattcccccagcttattaattaatgaaaggtataggccggggacgcacggtggctcacgcctgtaatcccagcacattgggaggcctcgtgcagatcatgaggtcaggagaacgagaccatc

SEQ ID NO: 497 - DNA, 486 bp, Homo sapiens
ccgctctagagtgacccctgcacacgccgaagaaccaggctgcttgcaatcatagcacgctacagcttcaaattcccaggctatagcgatcctcttgccttagcctccccagtagcagggactacaagtgtgcaccacggcactaagctccaatttttatttgttatctgcttctgtctataagctccacgaggacaggagccaactgtttatttcctactcttgcagggttttgtttgaccccttcaacaaatctctccacttgctgcattacaggggtctcttgccttttgccttctacttggatacaagcaataggagcaccaacaggtcagaagatggaaaagaatgaaatccagttatttattcccccagcttattaattaatgaaaggtataggccggggacgcacggtggctcacgcctgtaatcccagcacattgggaggcctcgtgcagatcatgaggtcaggagaacgagaccatc

SEQ ID NO: 498 - DNA, 816 bp, Homo sapiens
cgcgcgtggcgagtctgtgtcctccctgtcccccagagcagagaaccctctctgtgtctggaccggggaggagcagacgctggacaggtttttggcagaatgctggcaattcccaggaagatatgtggagaacggaaaggttgctacacccaaatagtggcgcaaaggctatgattatggaggattggacctgcaaactccagaacagagcaaccttgtaaaatgtgtgtgggcagcacagagaccttgggcaagttaacagtttcctcatctgtaaatactgatttatggaaagcacctggtgtatgttctgccctctgaggaccctgccctttcccaaaaggggtatcttaagaaggaaaatatggctgctctttgccggacagcagagtcccagagtctcgttctgttgcccaggctggagtgcagtggcgtgatctcggctcactgcaagcttcgcctcccgggttcacgccattctcctgcttcagcctcccgagtagctgggactacaggcgcccaccaccatgcctggctaattttttttgtatttatagtagagatggggtttcaccgtgttagccaggatggtctcgatctcctgacctcgtgatctgcccgcctcggcctcccaaagtgctgggattacaggcgtgagccactgcacccagccgatagttttcttataattgagttctgtatataaaattactgtaaaacaaaactatcaaattatgtcaagggggtatacgcattttaagattttaagattctttaatatatgagtcaataaaatcttgtctttgacactgcgaa

SEQ ID NO: 499 - DNA, 984 bp, Homo sapiens
cgcgcgtggcgagtctgtgtcctccctgtcccccagagcagagaaccctctctgtgtctggaccggggaggagcagacgctggacaggtttttggcagaatgctggcaattcccaggaagatatgtggagaacggaaaggttgctacacccaaatagtggcgcaaaggctatgattatggaggattggacctgcaaactccagaacagagcaaccttgtaaaatgtgtgtgggcagcacagagaccttgggcaagttaacagtttcctcatctgtaaatactgatttatggaaagcacctggtgtatgttctgccctctgaggaccctgccctttcccaaaaggggtatcttaagaaggaaaatatggctgctctttgccggacagcagagtcccagaaccccatgcaggtgtttcagggctttacgtcattcaaggatgtggctgtgaacttcactaggaagaatggagagtactggaccttgctcagagagtcttgtacagggatgtaatgctggagaactataggaacctggtctccttgggatttccattttccaaacctggtatcatctcctagttggaagaagtggtaggcccacgaacgcaaatgcaggagggagaggtgccaagaagcagctcagcctcccgagtagctgggattacaggtgcctgccaccacacccagctaacgttttgtatttttagtagagatggggtttcaccatgttggccaggcagatctcaaacttctgacctcgtgatgcactcacctcggcctcccaaagtgctgggattgcaggcgtgagccactgcgccctgcctgtttgtagtaatttttaggcaccaaatctccctcatcttctagtgccattctcctctctgttcaggtaaatgtcacactgtgcccagaatggatgaccaggaaccttcaagagtggctgaaaagattgcagagttatcataataaattgctaacttgcgt

SEQ ID NO: 500 - DNA, 434 bp, Homo sapiens
gccagagcaggatgaccatatcatttaaattcattccaaagacaataggaaaccattttaagcctgggagtaactttaaaaaaagatgactctgactgtcatagagggtatagagcgcaagattggaagcaaggaaagtagttatgtttctacctcgtgttttgtgacttgtatatttcccttcactatttcattaatatctttcaggattgttaatgtcctgctgtgttctcatttttaacagctgcataggaatctggtatgataccctactttgttaatcctctgagtgcctagattgtatccaatttttttattatcatgaacagcactgaaatgagtgttgttaaatctttctgcacatttttgttctcaggataattcccaacaggggaagtccttgaccaagagtaggattcatttgaagacttttt

SEQ ID NO: 501 - DNA, 171 bp, Homo sapiens
aagaaagaaagaaagaaagaaaggaaggaaggaaggaaagaattgcaatctctatgtagtattggaggtggggcctggtgggaggtaattggatcacaggggtggattgctcatgaatggtttagcaccatcctcttggtgcaggtgcagtcctcatgatagcgagtgagt

SEQ ID NO: 502 - DNA, 672 bp, Homo sapiens
tgaaacattaaataagaaaaaagtattatttaagttttctgttaaatactggttttattttttctatcaaaaagtcataaaaatttaaattaatgtatattatttaaagttatttactaagtgaatctaaacttaatcattttctataggtaaatagtgaacttatttttgattcaaatgtgcttatactaattatagtaattgaaattataatgggaaagggaaaactttatataatttgtgacatgagtatgtctaggaccattctaaaaataacagcagagttggttgcttccatgtatgatgcatataacctagagtagggtaacctcctgcccgtcagtggtgtgccagagcacaggcttggggtgcacagtccatcagtgagcgaaacttgtaagtgtgttgtccaggcagtgtgccaagcagcatattccaacaaattgaagagaaagaaaatgtaagtctaattatggagacagaggcagaagcacagctcttctcaagtctatgtttgttgaattttattttaagatctctgccttttggaatgtatcttgcagatgttttcactgaattttacaagagacattgcacaattaggttatctcttgcatcctgtaacttaaatcattcaaagctcaggtccagcgtagaatttctagagaataa

SEQ ID NO: 503 - DNA, 629 bp, Homo sapiens
attccccatgtcgaccctaaattaagtgaagacttcatggttcatgtgactctcataatatttgatagtatgtattatttaattacttaatatccactaattagactcttttccttctaaagaagaatgtcccccaaacaacacattgtaactttctaaaagacagttggtgccagatgagattaaaaatgcagttactctactagataatattcaccttacacttcggtaaacactcctttaataactatttgttggtttctcaaaagcaatatcccatattaaacagacaattcaaatgtgacaattcctctgtaacaaagaagctgaattctgtaataaatgggaaacatttcattccagtcttctcaggtaccagaatcatggacttcagtagaagagagggaatagggagagaggtgggaggctgatctgttcgtggcccagcacggtgctgtaattcctgacccttctggtttccacagatcattgcagagtaatgcttgaagcgtgtgactttggacttctgctgctttaaaaggcccagtggctttccaaccaaatccttagactcaatctattggtgtgtttgtctaataaattctttttgtagtaaattaaaaaaaaat

SEQ ID NO: 504 - DNA, 447 bp, Homo sapiens
tgctccaccatgagcttgcctgggccttggctcacctccggtgccacacagggacaacctctcttgtctcaatgagacccttatcaatagtacaacccctgggtttgccaatgtctgtccctttcaggtgtgaggaggttaaaaacttgttcagggtaaccaggtagcaacgggacaaatcactgtatctcgggaccccggggccccagggttgttttcaggagatgcggcctcagtggaagggacctttttttctagagggggcccaggcctccccaggccaagggtcctcgcttggctggaggcgtctctgctgctttgcctggtggggagggccccagtctgagtgtgccaccctccggagggcgtctcctctgagtgagtgctagctgagtgatgtgggcgccgtcctcacagggctgcttcccttgcgcgtgtgccggctgc

SEQ ID NO: 505 - DNA, 464 bp, Homo sapiens
aaacatgttcctcaaacccaattaatgtcgatgaccagcaatgaccaacacacttccacccctctgtgttttaagaaatgtcattcatctctatggaaaagagaacaaacaagaagcataaaggtatttttgaagtatactgttatgaggtacttggctagtaatttgcagcctaggtacacagcataccttttagcacggctatttatctctcagggagaatgctgccgtacttacgataaaggctctgttggacctcttcatcaatagcaaacctttaaggcacagcacatctcataaatagggagttccactaacacagactttcaaaagggtaggaacttggataatttcaaaaataggaggctattatttaaggtgtttccaggcagtccatccataaaagccgtcgtatattccaaatgccagagtcctccgagcaacatgacaggtctattagaata

SEQ ID NO: 506 - DNA, 272 bp, Homo sapiens
tctttaccctaggtgctatgggtttatgagaacataaatgatacatagttatagaatcacaagctgaatagactccaacattgtctaccatgaaagaaacatttattctccaccttatgccatgccactacttttgtttggacctattgaggtacatttattttattggattttaatgagcttgggacactgagaatgcatgtcaagaagtagaagggaggaaagaaaagaaaagtaatgttatggtctgctgtgctttcttacttaatacc

SEQ ID NO: 507 - DNA, 451 bp, Homo sapiens
ctgggtgtgatggtgtacgcttgtaatgccagctacatgggggctgaggcaggagaatcacttgaacatgggaggggaagttgcagtaagccgagatcatgccactgcactccagtctgggtgacagagtgagactctgtctcaagaaaaaaaaaaaagaaaaaagaaagtcaatgcaccatggggaagatcactctaagatcattctctggtaagagaaggacagttggcaaataagagttggagaaggagaattggactcagaatttttggggggtaatatgaattttgcaataacatatattttagggaatacatgggcagatcttcaactacatagttgtatagtataacatagcatagtatagtatgtgttctctgaaatttttcatgcccagttgtctctaggaaatacatggcgcattcccataaagacatgctccagtatgaa

SEQ ID NO: 508 - DNA, 575 bp, Homo sapiens
  misc_feature (22)..(22): n is a, c, g, or t
  misc_feature (25)..(26): n is a, c, g, or t
  misc_feature (28)..(28): n is a, c, g, or t
ggtcattaaaagtagatactgnaannantaatggtaggactgacacattccctcataaattttactagctagatgttgaaagttgaccaacaactctcaaaatatgattaagaaaaggaaacccacagaacagttcgattccaaaatgatttttttttttgcacgtcttacttatttggacttacattgaaatttcgctttataggagaaaggggacaacttgtccatcgtttccctgaagcagatatgttaatatttgacaaagaatcaaaatcattccattttaaactatcccattgcttgtttcaaatgcctaagaaaatgtgtcaatcttaaaacagaagagcatatgttgttaactttattcacacaaaattgtaaaggcaaagaaaatattctctttttaaaattaaaataggcatttcttatttttaaaaacattttgggggccaggggcagtggctcatgcctataatcccagaattttcagaggccaagcctggctaatcgcttgagcccaggaatatgagaacagcctgggcaatatggcaaaatctatctctacaaaaaaaaaa

SEQ ID NO: 509 - DNA, 1034 bp, Homo sapiens
cactgtggaatagtggtttctaaagctggctggacagcaaaaccacctggggagcttttaagaaactgaaattccatgtctcataccccagccctcacgtgaggtccaggaatctgtgtgattaaaaaatacaagccccaaaacaacttggaaagtggtcgttttgcaggtggggatttaggaaccaagaatccagaactctcctaccagggccccagaaaccgtaagttgaataagtgctgaaatgaggcaaattgatctactctctattgtgattaatatcttcacacagcaagtattttcctttgttttgagttcattccttgagatgagttatcgggagcggggtgactgggtccaggatatgaggatgtttagctcagtcatacccgcattttaacacgcaaacgtacggtgccgctcatttaaaaaccaaagtgttgtatacatgtagaagctatatattattccggggcagcccaaagaggggatgttgctttcaagcgaaagcaccaaatcacattcttttctggtaaaatagaatactaatgaattgcttttggaagaaatttccagagcattactgaatgttcaagtgcttcttagagcacaagttgaacctttcttatctctgcactcagtttctcgtaaaactgaagtcacagtgacctcttccccatttcgtagaaaagaaacccaaggaagagagtggttaagaaacagaagatacggttctcatcacatttgcctgagaactacgtatagtcatccattcagtgcctcgttaagtaaataaatgattgaatcatttgtatacatgacctcatggaaaaaagcacggtaaaatgaatgtttgagggtgggtagacagaattattcaacccggacaggtgttagatgttcactctatccccccctttttttttgcattaggttttattcattatttgcatcatctatggacctaaaagcatgctcattgtcacacagatgggaacagggtgaattttcaatgatttcaatgaaaaaaaaaa

SEQ ID NO: 510 - DNA, 584 bp, Homo sapiens
cactgtggaatagtggtttctaaagctggctggacagcaaaaccacctggggagcttttaagaaactgaaattccatgtctcataccccagccctcacgtgaggtccaggaatctgtgtgattaaaaaatacaagccccaaaacaacttggaaagtggtcgttttgcaggtggggatttaggaaccaagaatccagaactctcctaccagggccccagaaaccgtaagttgaataagtgctgaaatgaggcaaattgatctactctctattgtgattaatatcttcacacagcaagtattttcctttgttttgagttcattccttgagatgagttatcgggagcggggtgactgggtccaggatatgaggatgtttagctcagtcatacccgcattttaacacgcaaacgtacggtgccgctcatttaaaaaccaaagtgttgtatacatgtagaagctatatattattccggggcagcccaaagaggggatgttgctttcaagcgaaagcaccaaatcacattcttggacagtaaaggtcagaacgtgctagtcgctgtgtggcataaggccgggactgggag

SEQ ID NO: 511 - DNA, 999 bp, Homo sapiens
cactgtggaatagtggtttctaaagctggctggacagcaaaaccacctggggagcttttaagaaactgaaattccatgtctcataccccagccctcacgtgaggtccaggaatctgtgtgattaaaaaatacaagccccaaaacaacttggaaagtggtcgttttgcaggtggggatttaggaaccaagaatccagaactctcctaccagggccccagaaaccgtaagttgaataagtgctgaaatgaggcaaattgatctactctctattgtgattaatatcttcacacagcaagtattttcctttgttttgagttcattccttgagatgagttatcgggagcggggtgactgggtccaggatatgaggatgtttagctcagtcatacccgcattttaacacgcaaacgtacggtgccgctcatttaaaaaccaaagtgttgtatacatgtagaagctatatattattccggggcagcccaaagaggggatgttgctttcaagcgaaagcaccaaatcacattcttttctggtaaaatagaatactaatgaattgcttttggaagaaatttccagagcattactgaatgttcaagtgcttcttagagcacaagttgaacctttcttatctctgcactcagtttctcgtaaaactgaagtcacagtgacctcttccccatttcgtagaaaagaaacccaaggaagagagtggttaagaaacagaagatacggttctcatcacatttgcctgagaactacgtatagtcatccattcagtgcctcgttaagtaaataaatgattgaatcatttgtatacatgacctcatggaaaaaagcaattcattagtattctattttaccagaaaagaatgtgatttggtgtttcgcttgaaagcaacatcccctctttgggctgccccggaataatatatagcttctacatgtatacaacactttggtttttcaatgagcggcaccgtacgtttgcgtggtcgacgc

SEQ ID NO: 512 - DNA, 501 bp, Homo sapiens
gcttacattctaggtggggactctaacagaaggaggttgtagttcttccatatttgaaaaaagatagctttgttgttctatgaagaatggaagagggaggccaggcagctattgtctggcatctgcaggagagatggagaacagtggaggctccctgtgctcctgagtagagggtattattccagacaccccctttaaagtagcattttatgctgggtttgtttgttttttttttttttttttttttttttttttttgcagtgggggtggggtctggggggatttggtttggttttggctaaaatagtactggttttgcgtggcttcatgacttcatcttcccagtggtcaaaagaaatattttgagaagatggataaagctgaattgcaatctatggcttagaaatgaccaatgctagtcaatgcctttgggactttctatctcttcaccttacacacacacacacacacacacacacacacacacacacacacacacac

SEQ ID NO: 513 - DNA, 295 bp, Homo sapiens
cagccaaaatgaacaaatagaattaatccctaccttttcatccctcgaacatttaacctgctgctggagtgaccacatctgcatttgtcaagagcctctttagacattcttaagccaatgaaatgacattaacagaagaaaaggaatgttgggattgagacatgccaatgaaatagaaattagggttaaaataaagaaaatcaagacaaatataagtaaggtttttgttgttgttgttgtttctttttgagatacagtcttgccctgtggccgaggcttgagtggagtggtctgg

SEQ ID NO: 514 - DNA, 496 bp, Homo sapiens
tatacttttcaaatgtagtaaagcaaaataatatgtgtagtggaaggttccatagactcgaaggatgtgggcagagatttctggatcattctccttcactaacttccttagaaaatgaaatttccctgatctcagtgttctcaattaaatttcctttttttttttttgagacgaagtctcactctatcagccaggctggagtgcggtggtgtgatcttggctcacgtcaacctctgcctgccaggttcaagcaattctgccttggcctcccaagtagctgggattacaggtgcgtgccattgggcccagctaatttttgtatttttagtagagacgggttttcgccatgttggccaggctggtcttgaactcctgacctcaggtgatccaccctcttcagcctcccaaagtgctgggattacaggtatgagccaccacatctggctttaatttttgtatttttagtagaggtgggttttcaccatgttggccaggc

SEQ ID NO: 515 - DNA, 400 bp, Homo sapiens
gctaaggagttttcaagcaaaaggttgaagctgtttgcctgatttcttcttactgcttatgataaacagtaaatgagagaagtaagctaaggaagggctcctaaacaaaaagaacccagggctttgctggttttgagaattctcagtttctcagtatgtcaaatggctaagattaagaaatggcttctaagcaaagatcaaatccagggccttcttagaaaagcattgtctaaggatgtgagtgtaaattcctttgttaagacctcaggaggatttaagatgaacctcagagaaactttcgattgaagtagtaggtcctatacgaagtgtaaatgtatgtcacttagcagaagtttaaggttgagaagagtttttctcatttatgagtgtgctttttatc

SEQ ID NO: 516 - DNA, 439 bp, Homo sapiens
tgcacccatcaacccgtcatctacattaggtatttcttctaatgctatcccttccctagccccccaccccctgacaggccccggtgtgtgatgttctcctccccatgtccatgtattctcattgttcaactcccacttatgtttattgcagcactattcacaatagcaaagacttggagtcaacccaaatgcccatcaatgatagactggataaagaaaatgtggcacagatacaccatagaatagtatgcagccataaaaaaggatgagttcatgtccttttcagggacatggatgaagctggaaaccattattctcagcaaactaacacaggaatagaaagccaaaggctagtttctaggcgctcttttggtttgattttgaaatctgaaaaatcagcattgaagttatatgtgtgtgtgtgtgtgtgtgtgtgtgt

SEQ ID NO: 517 - DNA, 452 bp, Homo sapiens
ttgttggaaatgtgtatgtgtgaccttacaagtttggatctacatcattggtcatttgcagcagagcgcagcaggtgacctgctgaatttttctctggaaagaaagagggagggagcagagcctgcatctgacagctgtgtgtgcctcccggccggatatctggtttgcatctccctcagcttaaagctcccttcagcctggtgaggcaagtgtgactgtgcagccagccctgccaacccaggctgagtttcactgcaaatcaaggtttggcagcttcagcccagactggagttttcatgctgagattttcctagcattttgtgtttcatgactaaatatggtttgtgtttcaagaccaatgagctgggaactgtactgttctttcccctcccatcaactcatttttggcacaagacgcactctagtcagttggagcaaatcccctgacccg

SEQ ID NO: 518 - DNA, 571 bp, Homo sapiens
aggaccacctttcccagcctcaggggtgcacatcctcaggagctgcctacctccagatattgtaagtccatgcagaagaggaagggcccagctggggcacctcttggttgaggaatgagtatgtgacattttcatgtgggccacattttgatactactttaaaaaatagacccaagcacagtggctcacaccctgtaattcccagcacttcgggacgctgagagaggtggatcacctgaggtcaggagttcgagatcagcctggcccaacatggagaaaccccgcctctactaaaaatacaaaacattagctgggtgtggtggcacacacctgtaattcccagctactcgggaggcagaagcaggagaatcgcttgaatccaggaggcggaggttgcagtaagccgagatcacgccactacactccagcttacactggacatgatgaggaggaggaggatgatggtggtgattatgatagaaatggtgatggtgatgatgacaatggtgatagtagggatggtcttgctctgtcgcaatcaataaatgaatgcataaacacaaaaaaaaaa

SEQ ID NO: 519 - DNA, 574 bp, Homo sapiens
aggaccacctttcccagcctcaggggtgcacatcctcaggagctgcctacctccagatattgtaagtccatgcagaagaggaagggcccagctggggcacctcttggttgaggaatgagtatgtgacattttcatgtgggccacattttgatactactttaaaaaatagacccaagcacagtggctcacaccctgtaattcccagcacttcgggacgctgagagaggtggatcacctgaggtcaggagttcgagatcagcctggcccaacatggagaaaccccgcctctactaaaaatacaaaacattagctgggtgtggtggcacacacctgtaattcccagctactcgggaggcagaagcaggagaatcgcttgaatccaggaggcggaggttgcagtaagccgagatcacgccactacactccagcttacactggacatgatgaggaggaggaggatgatcttctgcacggtaggtgatcttctgcacgatgaggtgatcttctgcacgataaggtgatcttctgcacgatgaggtgatcttctgcacgctaaggtgatcttctgcacgat

SEQ ID NO: 520 - DNA, 366 bp, Homo sapiens
tagacttagacacattaaaatgatttgcccaagataaaagctgttcaagtgagagagcaagagaacctctggtcttctgacttctaagtctcattctttctcagtatgtttaacacatggtaaccaggaacttggaaatttacttagaaataacaacaacaaaaacctactggatgctgggaatgaaaagtgagtcacagactataaattgtagttttaaattaaaatgaataccattaatgtggtgctatcaatgtacagaggttggtaaacttaaaacacagcaacaacctatttcctatctatcttttgagaactgagaaccaagaattaaaaacacttttgtacatctcaaatgtggctaaa

SEQ ID NO: 521 - DNA, 490 bp, Homo sapiens
gtgtgccctcgtgaatgagttaatgccactataaaacgacctaactgagggagtttggtcttttttacccgtctgccacatgagaacacagacttcaaggtgccatcttgcaagcagaagcccagatcctcaccagacgccagatgccagctccttgatcttggacttcccagcctccagaactgtgagaaataaatctgtcgtttataaattacccagtctcaggtattctgttacagcagcacaaaacagactgactctatgaggagccaaacatatagaaacagaagtggaatgatggttgccagggctgagaagaggagggactgagaagttgcttcataggtgcagagtttcagatgtgcaagatgaaaaagttccaggatccctttcacaacaatgtgaatatacttaacggtgcacgactgaacggtgcacttaaaaatagttaagatggtacatttttatgttttctaccacaataaaaaaa

SEQ ID NO: 522 - DNA, 359 bp, Homo sapiens
gctcgtagggtttatcagactgtcaaggcacaaaaagttaatcgctgctgtgggaacaacctaaggatggctgttctggaagaagcgctttagttctagagggttgctagttaagagaggagtagcagcagagatttccttgtgccgttttaagtggggtaattggagaagagtaggaaccaaggtatccccaggtaagggtttgaaagctgtgtaagagagtctgtatttaacattactttccaggtgtgttttgtacttgtgtttaaaatggaattgtataaccacgttttaaaaatgattttagtgggtggggcacggtggctcacgcctctaatcccagcactttgggaggccga

SEQ ID NO: 523 - DNA, 467 bp, Homo sapiens
ccaaatagaattttaggacaataagtataggaaatatctctttatcgtaagataagaaacttgaactttttaaaggaaatgtcctcttgaaaagaacatttctgactgcatgcagaagggtacttaagacatatataacaggccaggagcagtggctcacgcctgtaatcccagcactttgggaggcccaagtgggcagataacctgaggtcaggagtttgagaccagcctgaccaacatggtgaaaccccatctctactaaaaatacaaaaattagccaggcatggtggcgcatgcctgtaatcccagctactcgagaggctgagcaacatggtgaaaccccgtctctactaaaaatacaaaaattatctgggcatggtggtgggcacctgtaatcccagctacttgggaggctgaggcaggagaatcgcttgaacctgggaggcagaggtcgcagtgagccaaga

SEQ ID NO: 524 - DNA, 394 bp, Homo sapiens
aacggtttccatttgccttaaaattgggttaaatagcaaaagcaatgtctttaaaaatgattagtttagagccttttagggtaaaccctgtttaaacacttaatcatggaattgcccttgccaccatgagctctaccatccacttccatatgtaaattataagagggacttcaattaagtcactcctgagaaaatatccttttttctagaagaaagaagataaattttgaggcaatttacatttggtatttcttttaatttcattttttgtattttaatttccctacatttttgttcaactaagagtgcttatttcttcttgaaggttaacattatgtttattaagtatcaaaatggaattatcttttaatctcatggtattctttatttgctc

SEQ ID NO: 525 - DNA, 1515 bp, Homo sapiens
ccaaatagaattttaggacaataagtataggaaatatctctttatcgtaagataagaaacttgaactttttaaaggaaatgtcctcttgaaaagaacatttctgactgcatgcagaagggtacttaagacatatataacaggccaggagcagtggctcacgcctgtaatcccagcactttgggaggcccaagtgggcagataacctgaggtcaggagtttgagaccagcctgaccaacatggtgaaaccccatctctactaaaaatacaaaaattagccaggcatggtggcgcatgcctgtaatcccagctactcgagaggctgaggcaggagaatcgcttgaacccgggaggcggaggttgcagttagccgagatcgtgccattgcactccagcctgggcaacaagagtaaaactctgtctcaaaaaaaaaaaaaaaaaaaaaaaaagcaatgtctttaaaaatgattagtttagagccttttagggtaaaccctgtttaaacacttaatcatggaattgcccttgccaccatgagctctaccatccacttccatatgtaaattataagagggacttcaattaagtcactcctgagaaaatatccttttttctagaagaaagaagataaattttgaggcaatttacatttggtatttcttttaatttcattttttgtattttaatttccctacatttttgttcaactaagagtgcttatttcttcttgaaggttaacattatgtttattaagtatcaaaatggaattatcttttaaaaaagaagacaagttttccatactgtcacagtaagctccaaagaactttgtctttctcataaagtaatattctttatttgcatccatttactatgattccgttaatttgttgaattaaatgcctttataaaaatatttacaaatgttttcttgccttaaaatgtaacattttctacttaaatttaatttccaagagagtgattatttgcattacaaaggaattcttaataattcctgtaagcctaggaaataggaatgccaaagtaacatttaatgtacttctctataacttttcataatcagaaattttaaattatgtttatataacccatttacttttattttaatgtgaatatatattcagaaattatttgatgtaaatttcaaaatgattataggaattaagctgaattctaatttttttgcttagatttagaaatatgtatgtgaaatttaagaatttatataatctgtgattagtggaaataagaacatccctactttgttcctaatgagtatattatgttattgttttgtttagtttgtgaacaaccatgtattagctttacttagctgatgtcagtaaatgtttctgtctcctaaatgtaaggactgtactcattaatttgtgtaaaagtaaaacactacagtagcagaaaaaattgcactggctctttagccaaaataagcactgtaacatggatgtattactattactgccaaataaaaaagtgatgg

SEQ ID NO: 526 - DNA, 446 bp, Homo sapiens
ccaatgagtttatttagcaaatgttatgaattcaggaaaattatgattaattttggagccccagtctagacctgtcattttaacactgaagaactacagttagatgctttgtgtggttattaagaagaacagtaattatttcagtagtataaaaatatcaacaatgattacaggtgactttttggcttaaatattcaactccccaacacctttcaagaatgttgtgagatcataaaaagtccaggagcaaaatattagttaaggaagaatgaggctatttaattggttagacttgttggtgagaaaggcatgctgtttgtagtctgtttccatgaccacagctgtttccccacccagtttttagtagtataatattaagccttaatttacaactgaaagttttccacctccggtcccgtagtccaaatcaagttattaaatttaaa

SEQ ID NO: 527 - DNA, 486 bp, Homo sapiens
aaattgtttttgaatttgttgtaatattaattaatgcttaggctatatccaagggtgagaaattaaatactgtgaacaaaaatgtaaacaggagactgacccgaagaagagaacccaagagattctgatccccattcctcagtcctggcaaccggtcaaaaggaaccccccaaaacaaaacaatataaagtcgtaagagataaccctgatagggctaggctatggagacactggatctacaggtactttcatttcttttctctgtttttccatgctgtgacatgttataaaatttcacaaatttaaaatgaatgaggccaggtactggtggctcgtgctggtaatcccagcactttgggaggcctaagtgggaggattaagtccaggagttcaagaccagcccctggccaatatggtgaaaccctgtctctacaaaaataaaaaaaagtagctgggcgtggtggcgtgcgcctgcagtcccagcta

SEQ ID NO: 528 - DNA, 396 bp, Homo sapiens
aaattgtttttgaatttgttgtaatattaattaatgcttaggctatatccaagggtgagaaattaaatactgtgaacaaaaatgtaaacaggagactgacccgaagaagagaacccaagagattctgatccccattcctcagtcctggcaaccggtcaaaaggaaccccccaaaacaaaacaatataaagtcgtaagagataaccctgatagggctaggctatggagacactggatctacaggtactttcatttcttttctctgtttttccatgctgtgacatgttataaaatttcacaaatttaaaatgaatgaggccaggtactggtggctcgtgctggtaatcccagcactttggttactctctagtgtcttcaggtagttcttgtctcgtgc

SEQ ID NO: 529 - DNA, 425 bp, Homo sapiens
gtcaatgatgaacatgccttcttgaagtacacagacaaaaaagtaattacaatatcatttataagtgtcatgatgtaaggatgagtagcgtattgtggaagtgcagatgaggggcacttaattagacttgggtgatcggggagggcttcctaggtgagtaggagatgttcagcctgagtgagggaaggaatcatccagcacgtgcaaaggtcaggaggcaagagttgatattgtattaagcagcagaaggctggaatgtagagtgagaaaggacaaaatggtaagagaagaggctgagaggccaggtgcggttgctcaggcctgtaatcccagcactttgggaggctgaggcgggcagatctcctgagctcaggagttcgagaccaccctgggcaacatggtgaaactccatctctactaaaata

SEQ ID NO: 530 - DNA, 291 bp, Homo sapiens
ggagtgtgtgagtcagtaacgatagtgtaggattttgctgttgccgacagtttatggattgttggttttgtattgtttttattttgtcttttggcaaggctgtgttccttccagttgagtgaggtggatagagttttgaactctggactctaccatcaccttattcctggagatgtatcagtaccgtatacacaggggaccctatgtgtggccatgagccttgctgtagaacctgtggctccagagagccacctggccacagagagcaaaagataattttagccttgaact

SEQ ID NO: 531 - DNA, 6623 bp, Homo sapiens
cgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgtaactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagacgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaaggcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttc

SEQ ID NO: 532 - DNA, 364 bp, Homo sapiens
ccatcctcatagctgactctagaggatacaaggagggcaagtactatttgcctactttttaagaaaagtgctagacctttacacagtgcctgacgtaactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggtaggtattcaagagtcctt

SEQ ID NO: 533 - DNA, 6412 bp, Homo sapiens
cgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgacctgtacacttgctactgttacacaaagtgatggaactattaaggaggatttcttgctcagtgtagaggtgaaaagcagttcaacaggcagctgatggaagtgatggaactattatggaggatttctagctcagtgtagaggtgaaacacagatgatggaaggaattgggattcatttcccctaatttgcaagtaacggctactcttaatttgcgattataactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagacgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaaggcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgt

SEQ ID NO: 534 - DNA, 4187 bp, Homo sapiens
tacctaaatggctgtaacgaattggtgtatgtttatgtttaacataagctttcctcttctagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaaggcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgt

SEQ ID NO: 535 - DNA, 6874 bp, Homo sapiens
cgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgacctgtacacttgctactgttacacaaagtgatggaactattaaggaggatttcttgctcagtgtagaggtgaaaagcagttcaacaggcagctgatggaagtgatggaactattatggaggatttctagctcagtgtagaggtgaaacacagatgatggaaggaattgggattcatttcccctaatttgcaagtaacggctactcttaatttgcgattataactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagacgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaaggcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggttttttttttgttccttttttaagcgccccccccaaaggggtacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttc

SEQ ID NO: 536 - DNA, 5419 bp, Homo sapiens
  misc_feature (5403)..(5403): n is a, c, g, or t
cgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgacctgtacacttgctactgttacacaaagtgatggaactattaaggaggatttcttgctcagtgtagaggtgaaaagcagttcaacaggcagctgatggaagtgatggaactattatggaggatttctagctcagtgtagaggtgaaacacagatgatggaaggaattgggattcatttcccctaatttgcaagtaacggctactcttaatttgcgattataactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagacgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaacccaagctttcaagggtggcaatcctaagaaagnaacccctgggggtaac

SEQ ID NO: 537 - DNA, 4928 bp, Homo sapiens
  misc_feature (4887)..(4888): n is a, c, g, or t
  misc_feature (4891)..(4891): n is a, c, g, or t
  misc_feature (4914)..(4914): n is a, c, g, or t
  misc_feature (4916)..(4916): n is a, c, g, or t
cgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgacctgtacacttgctactgttacacaaagtgatggaactattaaggaggatttcttgctcagtgtagaggtgaaaagcagttcaacaggcagctgatggaagtgatggaactattatggaggatttctagctcagtgtagaggtgaaacacagatgatggaaggaattgggattcatttcccctaatttgcaagtaacggctactcttaatttgcgattataactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagacgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaagttgttgagaaagagttattagaaaaagttaaacatcttgagaatcaaatagcaaaaagtcctgccattgactctaccagaggagattcttcaagcttagttgctgaacttcaagaaaagcttcannaanaaaaagctaagtttctagaacancntgaagagcaaga

SEQ ID NO: 538 - DNA, 2585 bp, Homo sapiens
  misc_feature (5)..(5): n is a, c, g, or t
  misc_feature (9)..(9): n is a, c, g, or t
  misc_feature (15)..(15): n is a, c, g, or t
  misc_feature (20)..(20): n is a, c, g, or t
ctcgncggnacggtngagcnaagaagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaaggcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttc

SEQ ID NO: 539 - DNA, 4653 bp, Homo sapiens
cgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgacctgtacacttgctactgttacacaaagtgatggaactattaaggaggatttcttgctcagtgtagaggtgaaaagcagttcaacaggcagctgatggaagtgatggaactattatggaggatttctagctcagtgtagaggtgaaacacagatgatggaaggaattgggattcatttcccctaatttgcaagtaacggctactcttaatttgcgattataactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagacgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaaggtaagaattaagtttagtctgtaattataaaattaaaatatcagtgattcgtttgtgtgtaatcacagtaccttgatttactcatttacc

SEQ ID NO: 540 - DNA, 2559 bp, Homo sapiens
aattagtggtcgtcaggccgtcgttcttcattgacgagaagatatggaaatacacatacaggaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaaggcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttc

SEQ ID NO: 541 - DNA, 3526 bp, Homo sapiens
cgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgacctgtacacttgctactgttacacaaagtgatggaactattaaggaggatttcttgctcagtgtagaggtgaaaagcagttcaacaggcagctgatggaagtgatggaactattatggaggatttctagctcagtgtagaggtgaaacacagatgatggaaggaattgggattcatttcccctaatttgcaagtaacggctactcttaatttgcgattataactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagacgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttacccatttcatcccctacaacggaagtagttaactggaagagattacccagagaataaaaagagcctccttcagtgga

SEQ ID NO: 542 - DNA, 497 bp, Homo sapiens
tagttttcattaaacttgattttacacttacatgaatgattttttggaagatagggataggaaggaatcttcacatgtgttagacttaatgtagtttctaaaacgtgtggagattttaacaaaaattatgtagcctgaggattttaatagacctgataaccagtttgagcatattcttttgctgttatttacctaagatcagccagttgttatggaatcctgttcattaaataggaagcttatatttttattactgtttttggggaaggttttagagtgaaattcattaacctctaaggtgtttttacatagtactacttggaaaataaagtcattgggcaaatataaacaactgatttattttatttcattttttgaagtgtggcagaccttaagcatgccattcaaagcaaatacaagattgctattcaacaccaggtgctggtggtcaatggaggagaatgcatggctgcagatcgaagagtgtgtacctacag

SEQ ID NO: 543 - DNA, 456 bp, Homo sapiens
ctccttttttaaaaaatataggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggtaagatataaacaattattttaactgattgtttctaaaagcattcggatctaaatagcacagtagtctaaattgcataggaagtatgcaaaaagtttgacaaataaactttaaaaatattttccggttaatatatctagttttaaaatttctgggtcatacattgctggttattctactttgataatgacagtattttagagtggaaaagctgtcttaacatgatttggtcaccttctttcctagataatatgtaaatagtta

SEQ ID NO: 544 - DNA, 287 bp, Homo sapiens
attcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacaggtctgtatctcttttcccatttcatttgagaactaaagaaggtagacataaattaacaaatataatttctttatgtagctgagggtttcttatatcttagatgtgatgttccttacattgatcctgttaataaatttcctcttgaca

SEQ ID NO: 545 - DNA, 179 bp, Homo sapiens
tacctaaatggctgtaacgaattggtgtatgtttatgtttaacataagctttcctcttctagtgggctggtgctttagtcaaagatggaaagagattatatgaagcagaaaaatcaaaaagggaatcctttgggaaattatttagtaagtgttcattaataattttaattacttttgta

SEQ ID NO: 546 - DNA, 5956 bp, Homo sapiens
  misc_feature (5753)..(5753): n is a, c, g, or t
  misc_feature (5785)..(5785): n is a, c, g, or t
  misc_feature (5792)..(5792): n is a, c, g, or t
  misc_feature (5846)..(5846): n is a, c, g, or t
  misc_feature (5853)..(5853): n is a, c, g, or t
  misc_feature (5859)..(5860): n is a, c, g, or t
  misc_feature (5864)..(5865): n is a, c, g, or t
  misc_feature (5868)..(5868): n is a, c, g, or t
  misc_feature (5878)..(5878): n is a, c, g, or t
  misc_feature (5882)..(5882): n is a, c, g, or t
  misc_feature (5888)..(5888): n is a, c, g, or t
  misc_feature (5956)..(5956): n is a, c, g, or t
cgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgacctgtacacttgctactgttacacaaagtgatggaactattaaggaggatttcttgctcagtgtagaggtgaaaagcagttcaacaggcagctgatggaagtgatggaactattatggaggatttctagctcagtgtagaggtgaaacacagatgatggaaggaattgggattcatttcccctaatttgcaagtaacggctactcttaatttgcgattataactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagacgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaaggcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggttttttttttacccnaacactttagaaatggcgcccaaccttctttnttttttnaaaggcctaccttggccatgggggttttgatagccttttaatggccggtaaatnaccctanctgganntaanngtnaatgtatttntccngcttgncctttgggaaaaagttcagaatcttgcccttctaaccatttttataaaggtaatttttcaacttttan

SEQ ID NO: 547 - DNA, 6711 bp, Homo sapiens
cgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgacctgtacacttgctactgttacacaaagtgatggaactattaaggaggatttcttgctcagtgtagaggtgaaaagcagttcaacaggcagctgatggaagtgatggaactattatggaggatttctagctcagtgtagaggtgaaacacagatgatggaaggaattgggattcatttcccctaatttgcaagtaacggctactcttaatttgcgattataactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagacgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaaggcttcaggtgcatctagaagaccctgggtacttggaaaagtaatggaaaaagaatactgtcaagccaaaaagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttc

SEQ ID NO: 548 - DNA, 6822 bp, Homo sapiens
cgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgacctgtacacttgctactgttacacaaagtgatggaactattaaggaggatttcttgctcagtgtagaggtgaaaagcagttcaacaggcagctgatggaagtgatggaactattatggaggatttctagctcagtgtagaggtgaaacacagatgatggaaggaattgggattcatttcccctaatttgcaagtaacggctactcttaatttgcgattataactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagacgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaaggcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttc

SEQ ID NO: 549 - DNA, 4685 bp, Homo sapiens
cgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgacctgtacacttgctactgttacacaaagtgatggaactattaaggaggatttcttgctcagtgtagaggtgaaaagcagttcaacaggcagctgatggaagtgatggaactattatggaggatttctagctcagtgtagaggtgaaacacagatgatggaaggaattgggattcatttcccctaatttgcaagtaacggctactcttaatttgcgattataactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagacgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctaaaagaatttaaattggagagagaagttgttgagaaagagttattagaaaaagttaaacatcttgagaatcaaatagcaaaaagtcctgccattgactctaccagaggagattcttcaagcttagttgctgaacttcaagaaaagcttcaggaagaaaaagctaagtttctagacatctgtagacactcggggtcctctagagtca

SEQ ID NO: 550 - DNA, 4539 bp, Homo sapiens
cgacaataacaaaccaagccgcggcggtgtccgcggccctgccgagccctcggcgttgcctcagaatcccccagtcgcctgggcccctcggctctgacaggccgcggccttctgtcccccggccccagacccagagccgaggggcctgctcgcgtccttgtccgcccggacccctccctgcctcctagagttcggggccgcggcgggcgggcgcccgggacgccggcggttgtgtcggcttagcggtgccgaatgggcggttggtaaccgctgccgaggactaggcggcggcggaagatggtgccgggggtcgctggctctgctgctgccgccggcgaaggaggaggcgttgccggttttctgagtttaaccagtaatgccattcagttgccaatctcaagcaaagcaaacataagccagttttaatctactttttaagaaaagtggtagtccttttcacagtgcctgacgacctgtacacttgctactgttacacaaagtgatggaactattaaggaggatttcttgctcagtgtagaggtgaaaagcagttcaacaggcagctgatggaagtgatggaactattatggaggatttctagctcagtgtagaggtgaaacacagatgatggaaggaattgggattcatttcccctaatttgcaagtaacggctactcttaatttgcgattataactgtatcagagggtgaggtataagctcacagaattcagataaatcatcatgaagttatatgtatttctggttaacactggaactactctaacatttgacactgaacttacagtgcaaactgtggcagaccttaagcatgccattcaaagcaaatacaagattgctattcaacaccaggtgctggtggtcaatggaggagaatgcatggctgcagatcgaagagtgtgtacctacagtgctgggacggatacaaatccaatttttctttttaacaaagaaatgatcttatgtgatcgtccacctgctattcctaaaactaccttttcgacagaaaatgacatggaaataaaagttgaagaatctcttatgatgcctgcagtttttcatactgttgcttcaaggacacagcttgcattggaaatgtatgaagttgccaagaaactttgttctttttgtgaaggtcttgtacatgatgaacatcttcaacaccaaggctgggctgcaatcatggccaacctggaggactgttcaaattcataccaaaagctacttttcaagtttgaaagtatttattcaaattatctgcagtccatagaagacatcaagttaaaacttactcatttaggaactgcagtttcagtaatggccaagattccactgttggagtgcctaaccagacatagttacagagaatgtttgggaagactggattctttacctgaacatgaagactcagaaaaagctgagacgaaaagatccactgaactggtgctctctcctgatatgcctagaacaactaacgaatctttgttaacctcatttcccaagtcagtggaacatgtgtccccagataccgcagatgctgaaagtggcaaagaaattagggaatcttgtcaaagtactgttcatcagcaagatgaaactacgattgacactaaagatggtgatctgcccttttttaatgtctctttgttagactggataaatgttcaagatagacctaatgatgtggaatctttggtcaggaagtgctttgattctatgagcaggcttgatccaaggattattcgaccatttatagcagaatgccgtcaaactattgccaaacttgataatcagaatatgaaagccattaaaggacttgaagatcggctctacgccctggaccagatgattgctagctgtggccgactggtgaatgaacagaaagagcttgctcagggatttttagctaatcagaagagagctgaaaacttaaaggatgcatctgtattacctgatttatgcctgagtcacgcaaatcagttgatgattatgttgcaaaatcatagaaaactgttagatattaagcagaagtgtaccactgccaaacaagaactagcaaataacctacatgtcagactgaagtggtgttgctttgtaatgcttcatgctgatcaagatggagagaagttacaagctttgctccgcctcgtaatagagctgttagaaagagtcaaaattgttgaagctcttagtacagttcctcagatgtactgcttagctgttgttgaggttgtaagaagaaaaatgttcataaaacactacagggagtgggctggtgctttagtcaaagatggaaagagattatatgaagcagaaaaatcaaaaagggaatcctttgggaaattatttaggaagtcttttttaagaaatcgtctgtttaggggactggactcctggcccccttccttttgtactcaaaagcctcgaaagtttgactgtgaacttccagatatttcattaaaagatttacagtttctgcaatcattttgtccttcggaagttcagccattcctcagggttcccttactttgtgactttgaacctctacaccagcatgtacttgctctacataatttggtaaaagcagcacaaagtttggatgaaatgtcacagaccattacagatctactgagtgaacaaaaggcatctgtgagtcagacatccccacagtctgcttcttcaccaaggatggaaagtacagcaggaattacaactactacctcaccgagaactcctccaccactgactgttcaggatcccttatgtcctgcagtttgtcccttagaagaattatctccagatagtattgatgcacatacgtttgattttgaaactattccccatccaaacatagaacagactattcaccaagtttctttagacttggattcattagcagaaagtcctgaatcagattttatgtctgctgtgaatgagtttgtaatagaagaaaatttgtcgtctcctaatcctataagtgatccacaaagcccagaaatgatggtggaatcactttattcatcagttatcaatgcgatagacagtagacgaatgcaggatacaaatgtatgtggtaaggaggattttggagatcatacttctctgaatgtccagttggaaagatgtagagttgttgcccaagactctcacttcagtatacaaaccattaaggaagacctttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtctttaaaaaatgaatatgaaggtaaacttgacggactaataaaggaaactgaagagaatgaaaacaaaattaaaaaattgaagggagagttagtatgccttgaggaggttttacaaaataaagataatgaatttgctttggttaaacatgaaaaagaagctgtaatctgcctgcagaatgaaaaggatcagaagttgttagagatggaaaatataatgcactctcaaaattgtgaaattaaagaactgaagcagtcacgagaaatagtgttagaagacttaaaaaagctccatgttgaaaatgatgagaagttacagttattgagggcagaacttcagtccttggagcaaagtcatctaaaggaattagaggacacacttcaggttaggcacatacaagagtttgagaaggttatgacagaccacagagtttctttggaggaattaaaaaaggaaaaccaacaaataattaatcaaatacaagaatctcatgctgaaattatccaggaaaaagaaaaacagttacaggaattaaaactcaaggtttctgatttgtcagacacgagatgcaagttagaggttgaacttgcgttgaaggaagcagaaactgatgaaataaaaattttgctggaagaaagcagagcccagcagaaggagaccttgaaatctcttcttgaacaagagacagaaaatttgagaacagaaattagtaaactcaaccaaaagattcaggataataatgaaaattatcaggtgggcttagcagagctaagaactttaatgacaattgaaaaagatcagtgtatttccgagttaattagtagacatgaagaagaatctaatatacttaaagctgaattaaacaaagtaacatctttgcataaccaagcatttgaaatagaaaaaaacctaaaagaacaaataattgaactgcagagtaaattggattcagaattgagtgctcttgaaagacaaaaagatgaaaaaattacccaacaagaagagaaatacgaagctattatccagaaccttgagaaagacagacaaaaattggtcagcagccaggagcaagacagagaacagttaattcagaagcttaattgtgaaaaagatgaagctattcagactgccctttggactgaaaaactccaagtcctgggtacctgagctctgaattcagtaactcagtggtc

SEQ ID NO: 551 - DNA, 2432 bp, Homo sapiens
tttactttttagattcaaagagagggttcacacagatatctttcatgctacattattgagcttaaggaagataaatttcccaaatatgatatttggtatatttgtgtgtctgtaattttttttttaatttaatgctgtatttaatttgtaagtcctgccattgactctaccagaggagattcttcaagcttagttgctgaacttcaagaaaagcttcaggaagaaaaagctaagtttctagaacaacttgaagagcaagaaaaaagaaagaatgaagaaatgcaaaatgttcgaacatctttgattgcggaacaacagaccaattttaacactgttttaacaagagagaaaatgagaaaagaaaacataataaatgatcttagtgataagttgaaaagtacaatgcagcaacaagaacgggataaagatttgatagagtcactttctgaagatcgagctcgtttgcttgaggaaaagaaaaagcttgaagaagaagtcagtaagttgcgtagtagcagttttgttccttcaccatatgtagctacagccccagaactttatggagcttgtgcacctgaactcccaggtgaatcagatagatccgctgtggaaacagcagatgaaggaagagtggattcagcaatggagacaagcatgatgtctgtacaagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaaggcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttc

SEQ ID NO: 552 - DNA, 1793 bp, Homo sapiens
ggcacgacctcgtgcgaattcggcacgagagaaaatattcatatgttgtctgaagaaaaacagcggataatgctgttagaacgaacattgcaattgaaagaagaagaaaataaacggttaaatcaaagactgatgtctcagagcatgtcttcagtatcttcaaggcattctgaaaagatagctattagagattttcaggtgggagatttggtactcatcatcctagacgaacgccatgacaattatgtgttatttactgttagtcctactttatattttctacattcagagtctctacctgccctggatctcaaaccaaggcttcaggtgcatctagaagaccctgggtacttggaaaagtaatggaaaaagaatactgtcaagccaaaaaggcacaaaacagatttaaagttcctttggggacaaagttttacagagtgaaagccgtatcatggaataagaaagtataacttatggacaaaattaatacattctatgacatttttttctgatttgtcctgcagtgctcattcatcactccaaaaacagcaggccatctttttatgcaaaagtcagcgtgacaatatacttcactggtgtacatcgtttactttttaactggcttcattttaggaataataaattcatcagaatccttggctgaattaaaatggtttttgttttttggtttttttttttacccagacaactctagaaatgcggaccaaactacttcattttctcaaagggcataccttgtgcattgtggcttatgatgagccatattaattgcctgttaaatatacactagcttgaacttagatgttaaatgttattattaccagcatttgtccttttgtgaaatcagtatcagaatacttgcactctttaacacattctttataaaatgtataaattattcagaactatttaaaataaagaggagtgttattgcatgctgataatcattttgagtttgcctcagtagatactaaagcaaattgtttcagtttttttaaatgccctttgatgtttcaaaaaaaaaaaggaactgtaatttgattgactgattttaagatcagccataagtaatcagcaatcttcaaaagcactttcagtggattggtcatctgggttctaaagggaagagtctgtgctactaaccatttcaaatgcagactcaaaccttcccaacatctttatgactctagaataatcatattgatgaaatcgtaattcatggttgagtttcagaacaaaagatattcattgcacattaaccatttagaggtcatttaaataacaaaatattgtattgtaaaagaactgtacaattttaaaacaataaagatttgaacctgtaaatgtgtgtgccttttaaagaaggatacatttttaatatatttgagtgattgctgggaagtgtgaaaatattgttatgtatcatatcaaagagaaacatgtttattacaaaaatgttctttaactatatactatgtaacagggtaaacagtgttatgtagaatagaattgtgtaaactagatctttagagaagttgccattgagcaaagttatttaaatgagttagttgagttggatgagaattgtttgaggtttgttgctagagaacaataataaaataattctttttcagaaaatatttaatttcttcataaaaataagttaaatatttttttaaatatgtatatctaatagtacaaaatggaataaacatcatagtgtatagaaaactgaatttgacaagttaatgaataaatgaacaaatgatttc

SEQ ID NO: 553 - DNA, 2280 bp, Homo sapiens
aggttcgtgacccttgagaaaagagttggtggtaaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccactcacaaacataacaatggtcagcccatttggtttaccctgggcatcctggaggctctcaaaggttgggaccagggcttgaaaggaatgtgtgtaggagagaagagaaagctcatcattcctcctgctctgggctatggaaaagaaggaaaaggtaaaattcccccagaaagtacactgatatttaatattgatctcctggagattcgaaatggaccaagatcccatgaatcattccaagaaatggatcttaatgatgactggaaactctctaaagatgaggttaaagcatatttaaagaaggagtttgaaaaacatggtgcggtggtgaatgaaagtcatcatgatgctttggtggaggatatttttgataaagaagatgaagacaaagatgggtttatatctgccagagaatttacatataaacacgatgagttatagagatacatctacccttttaatatagcactcatctttcaagagagggcagtcatctttaaagaacattttatttttatacaatgttctttcttgctttgttttttatttttatatattttttctgactcctatttaaagaaccccttaggtttctaagtacccatttctttctgataagttattgggaagaaaaagctaattggtctttgaatagaagacttctggacaatttttcactttcacagatatgaagctttgttttactttctcacttataaatttaaaatgttgcaactgggaatataccacgacatgagaccaggttatagcacaaattagcaccctatatttctgcttccctctattttctccaagttagaggtcaacatttgaaaagccttttgcaatagcccaaggcttgctattttcatgttataatgaaatagtttatgtgtaactggctctgagtctctgcttgaggaccagaggaaaatggttgttggacctgacttgttaatggctactgctttactaaggagatgtgcaatgctgaagttagaaacaaggttaatagccaggcatggtggctcatgcctgtaatcccagcactttgggaggctgaggcgggcggatcacctgaggttgggagttcgagaccagcctgaccaacacggagaaaccctatctctactaaaaatacaaaagtagccgggcgtggtgatgcgtgcctgtaatcccagctacccaggaaggctgaggcggcagaatcacttgaacccggaggcggaggttgcggtaagccgagatcacctccagcctggacactctgtctcgaaaaaaagaaaagaaacacggttaataacatataaatatgtatgcattgagacatgctacctaggacttaagctgatgaagcttggctcctagtgattggtggcctattatgataaataggacaaatcatttatgtgtgagtttctttgtaataaaatgtatcaatatgttatagatgaggtagaaagttatatttatattcaatatttacttcttaaggctagcggaatatccttcctggttctttaatgggtagtctatagtatattatactacaataacattgtatcataagataaagtagtaaaccagtctacattttcccatttctgtctcatcaaaaactgaagttagctgggtgtggtggctcatgcctgtaatcccagcactttgggggccaaggagggtggatcacttgagatcaggagttcaagaccagcctggccaacatggtgaaaccttgtctctactaaaaatacaaaaattagccaggcgtggtggtgcacacctgtagtcccagctactcgggaggctgagacaggagatttgcttgaacccgggaggcggaggttgcagtgagccaagattgtgccactgcactccagcctgggtgacagagcaagactccatctca

SEQ ID NO: 554 - DNA, 1104 bp, Homo sapiens
aggttcgtgacccttgagaaaagagttggtggtaaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccactcacaaacataacaatggtcagcccatttggtttaccctgggcatcctggaggctctcaaaggttgggaccagggcttgaaaggaatgtgtgtaggagagaagagaaagctcatcattcctcctgctctgggctatggaaaagaaggaaaaggtaaaattcccccagaaagtacactgatatttaatattgatctcctggagattcgaaatggaccaagatcccatgaatcattccaagaaatggatcttaatgatgactggaaactctctaaagatgaggttaaagcatatttaaagaaggagtttgaaaaacatggtgcggtggtgaatgaaagtcatcatgatgctttggtggaggatatttttgataaagaagatgaagacaaagatgggtttatatctgccagagaatttacatataaacacgatgagttatagagatacatctacccttttaatatagcactcatctttcaagagagggcagtcatctttaaagaacattttatttttatacaatgttctttcttgctttgttttttatttttatatattttttctgactcctatttaaagaaccccttaggtttctaagtacccatttctttctgataagttattgggaagaaaaagctaattggtctttgaatagaagacttctggacaatttttcactttcacagatatgaagctttgttttactttctcacttataaatttaaaatgttgc

SEQ ID NO: 555 - DNA, 762 bp, Homo sapiens
aggttcgtgacccttgagaaaagagttggtggtaaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccactcacaaacataacaatggtcagcccatttggtttaccctgggcatcctggaggctctcaaaggttgggaccagggcttgaaaggaatgtgtgtaggagagaagagaaagctcatcattcctcctgctctgggctatggaaaagaaggaaaaggtaatagtatttctgtatttttcttactatagcactagagttgttctctggattaggagacagaagttagagtcactataacttttttttttcccctggaagttaatagggggtatgtattcctttagcaactgtattatgtcttgagtatcaattgaaatggccagtttaaggccgtaatgtctaaatgggcaactatgctaacaataaaaaaagaacattgaggtctattaatac

SEQ ID NO: 556 - DNA, 2372 bp, Homo sapiens
aggttcgtgacccttgagaaaagagttggtggtaaatgtgccacgtcttctaagaagggggagtcctgaacttgtctgaagcccttgtccgtaagccttgaactacgttcttaaatctatgaagtcgagggacctttcgctgcttttgtagggacttctttccttgcttcagcaacatgaggcttttcttgtggaacgcggtcttgactctgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccactcacaaacataacaatggtcagcccatttggtttaccctgggcatcctggaggctctcaaaggttgggaccagggcttgaaaggaatgtgtgtaggagagaagagaaagctcatcattcctcctgctctgggctatggaaaagaaggaaaagtcttttagtacatgcttgcatgcctcttttggaaagataccagttttatcaacaacctagcgcatgtcacatctctgtctagatctgaaatggtaaaattcccccagaaagtacactgatatttaatattgatctcctggagattcgaaatggaccaagatcccatgaatcattccaagaaatggatcttaatgatgactggaaactctctaaagatgaggttaaagcatatttaaagaaggagtttgaaaaacatggtgcggtggtgaatgaaagtcatcatgatgctttggtggaggatatttttgataaagaagatgaagacaaagatgggtttatatctgccagagaatttacatataaacacgatgagttatagagatacatctacccttttaatatagcactcatctttcaagagagggcagtcatctttaaagaacattttatttttatacaatgttctttcttgctttgttttttatttttatatattttttctgactcctatttaaagaaccccttaggtttctaagtacccatttctttctgataagttattgggaagaaaaagctaattggtctttgaatagaagacttctggacaatttttcactttcacagatatgaagctttgttttactttctcacttataaatttaaaatgttgcaactgggaatataccacgacatgagaccaggttatagcacaaattagcaccctatatttctgcttccctctattttctccaagttagaggtcaacatttgaaaagccttttgcaatagcccaaggcttgctattttcatgttataatgaaatagtttatgtgtaactggctctgagtctctgcttgaggaccagaggaaaatggttgttggacctgacttgttaatggctactgctttactaaggagatgtgcaatgctgaagttagaaacaaggttaatagccaggcatggtggctcatgcctgtaatcccagcactttgggaggctgaggcgggcggatcacctgaggttgggagttcgagaccagcctgaccaacacggagaaaccctatctctactaaaaatacaaaagtagccgggcgtggtgatgcgtgcctgtaatcccagctacccaggaaggctgaggcggcagaatcacttgaacccggaggcggaggttgcggtaagccgagatcacctccagcctggacactctgtctcgaaaaaaagaaaagaaacacggttaataacatataaatatgtatgcattgagacatgctacctaggacttaagctgatgaagcttggctcctagtgattggtggcctattatgataaataggacaaatcatttatgtgtgagtttctttgtaataaaatgtatcaatatgttatagatgaggtagaaagttatatttatattcaatatttacttcttaaggctagcggaatatccttcctggttctttaatgggtagtctatagtatattatactacaataacattgtatcataagataaagtagtaaaccagtctacattttcccatttctgtctcatcaaaaactgaagttagctgggtgtggtggctcatgcctgtaatcccagcactttgggggccaaggagggtggatcacttgagatcaggagttcaagaccagcctggccaacatggtgaaaccttgtctctactaaaaatacaaaaattagccaggcgtggtggtgcacacctgtagtcccagctactcgggaggctgagacaggagatttgcttgaacccgggaggcggaggttgcagtgagccaagattgtgccactgcactccagcctgggtgacagagcaagactccatctca

SEQ ID NO: 557 - DNA, 317 bp, Homo sapiens
ctcctggagattcgaaatggaccaagatcccatgaatcattccaagaaatggatcttaatgatgactggaaactctctaaagatgaggtgacctttccttcttcctactcctctttctacttttctttggttgtttggggttttgttttgttttgtttttgtaactcactttttaaatgaatatgtgtatatttcaaatctacttttatttaggtaacatttatttataagttttcttaaaatactgatgctttgaaagtggactttttcatagtgaatcactgttttggagagaaatatattaagacttaaaaagc

SEQ ID NO: 558 - DNA, 596 bp, Homo sapiens
tgttcgtcacttctttgattggggctttgatccctgaaccagaagtgaaaattgaagttctccagaagccattcatctgccatcgcaagaccaaaggaggggatttgatgttggtccactatgaaggctacttagaaaaggacggctccttatttcactccacgtaagtaattatgccccgcaggtaaaatagtaattaagaatccactcacttatgccagctctccagcaggaaaggtggcctgtacctggttttgcctcttttacaaaaccgaaatatcttatttccttctttgggaaaggaaattgtttaaagccagttttatatagcgagcgaggcctttgaaggtcttgttggaaacatgtggtctggaaaaggctgttaattttttttattatacaaattagaactagaatctttgaaatattgcagaaatatatctgggtgtataattggccaataagtagaaaaagcccaaaagaattctcatatctcaaactccatttcttaaagaaaatgacttgattccatttttaatgtggtgtaggtgatgttcacctaaaacttttcacagcgacttcaaaagcaaactaca

SEQ ID NO: 559 - DNA, 501 bp, Homo sapiens
agccacctggcgtcagcagttactgtgtggcggctgcacggggatgatggcagctggatggatgacagccgtcgtcaggagaaacttcaaagataaagtgaacaggataaataggatgcgttggaaatctgaaacatgacagtattcgttttcttaaaagaaatgtaaactcccctcctccccactaaattctagagtaaccaacacatttagaagatctagaatctaagtgaaagtttccaggttgtggcctcagtaacatgtttttgcatatcaagaagctcagacagagcctgtaatgtacccttggcaggaatcatggagaaggggagtgtcagcatcagctccatcactggaccaaagccgagactccttgacttggatttcattgaatcgtttaaaattaggttctgatgtttctacttttccatgtaagaatgttaaaaagttaaaaagttacttctttctgcccaacaccattccattccacagactggtatt

SEQ ID NO: 560 - DNA, 409 bp, Homo sapiens
ataaagttttcagacaacatccagaagaaattttatgtaatagttaaggtcaacagatacgattccaacaacacacataactcaactgaagtgaaaacaatatgaatagctgtgactggtgtcacatgtggatgataatgacaacccagtcatgtctgccacctggccaacatcaattatacaaagtcattgattttaagattcattgattgtaaaagatttcaatgacattaaaatgtgtaggaaatgtgcatcttagaattgttaaacaataagtagtacttttgcctctgagaattggaagttgcagtaataaagtaagatgctaaggcatgtaaatgtttttaataaatacatggttttcaagagttaatacatgattgaagaggtttagaatcaattctctagg

SEQ ID NO: 561 - DNA, 148 bp, Homo sapiens
aagaatactaaggcctatatatagatatgcatatggtaaactgcctttctttcaggtgctaaaaagggaaactgaataaacaacatttcacaattccaaacaaacaagttaataaaatattcagttcatcaaagtgtaacactcacat

SEQ ID NO: 562 - DNA, 341 bp, Homo sapiens
tcattaatgactcatctctgtcctaaaagcaatcaggatgactgttcagtgcccctcctggcaccatgtgacccacataaggagtgtcttcagactgaagctttgctagaactcagagttttacaggctctgcccaggagcctctctggcattttctcacacagtctaacaggcagaaaatctcttctttctttttgtgatctttgacgaatattgttggatcttctgattctgacagcctttagcagtgctccattcaggtgcagggcagtggatgcctaggctgctgccttcatagcttctcccgctctctctatcctttttatctttaatgtcctgca

SEQ ID NO: 563 - DNA, 264 bp, Homo sapiens
aagagtgcagtgctgaaaatatacttaaagaaatcatagctgaaaactccccaaatttggtggaaggtgtaaatcttcagatttaagaaaatgagcaaaccccaagccaagaggactcaacaaccctaaaatagtatgcactgaacaacaaagttataaaataatgtgaaaactgacagaattgaaagaagaaatagataaatccacaattacagcgtggacttcaacatccttctatcactaactgatagaaccattagacaa

SEQ ID NO: 564 - DNA, 318 bp, Homo sapiens
ctaccttgagatgaacaccctagtcccctgctttcttagaagcacaaaccttacctccttcattcaggaccattatggccattctacctaagaatattcctaccagaacatttctggtactggaaaggtgttcatcaatatctactgcataaacagtgccatcatggaacctataactagctcagaacggctatgttttagatgattatttttaaaaagttagaaatcgcaaatataaaagctaagcccaaacaaaaaaagctaagcataaaaacgtaaaagaataccaactgtgataagaaggacaaaaaaacaata

SEQ ID NO: 565 - DNA, 495 bp, Homo sapiens
gaggttgcagtgagctgagatcgcaccatttcactccagcctggggacagcaagactccgtcttgaggaaaaataaacaaataataaataaataagaagtttctaatctgaatggtcagagtccaacacatcgactgggctatatggcagatggtattttccaaaatcatctcatctctcatgctgttcttatgtgatgcgaacacgtctctgttgtgaggtggggtctccctccaaacctaggctgaccttagtaactgcctcaacgaatccaatgtagtcatgctgcctgacttttttctcttgagagggagtttcgctcttgttgcccaggctggagtgcaatggcgcgatctcggctcactgcaacttccgcctcccaggttcaagcgattctgcctcctgagtagctgggattacaggcatgcgccaccatgtctggctaattttttgtatttttagtagagacagggtttctccatgttcgtcaggctg

SEQ ID NO: 566 - DNA, 314 bp, Homo sapiens
tgcactagctgttccatctttcagggctctctccccaccccccggtaccagcatggattgatcctcacttcctgcagggttctgaaggggagagtcctttttccattgccccagccctcgctgtctccctttccttgcttcatttgtcccacagcagtgatcagcatttgaccttttgtgtatttgttgatgtctgtcttcctccagtggaatgaaagttctgggacagcgaggtcttggtctattgtatgttctgctctattcccaggactgggaacagtgcctggcatatagtagaaccttaataaataatt

SEQ ID NO: 567 - DNA, 283 bp, Homo sapiens
gtcacctaaaaaggcttgatggctggcccctagtgacattagcagccccacccctaaagatacctcatggaatgccagagactctggctgtaccctctgtgacatcacatggaatgggctggcccctgctaatatcacatagaatggctttatgacctgactcccaccataccatgttggaggtccccaacccccatgacatcatgaggagtgccatgcaggcctggccttcagggacatcacaggaaagaggaggctccggaccccaccccctacaagctgt

SEQ ID NO: 568 - DNA, 400 bp, Homo sapiens
gtggttttaaactcctgggctcaagcatctcatccatcttggcttcccaaatttctgggattactggagtgagccactgcacccagcctaattttttttttgatagtctcattttttctagtgactccattaaagaataggctagttcctaagcacctcaactcatcccacctggctttccagtaagctaggaaatgtgtctgagaattgggtaaaatggaagagatggagagaagggtagacaatcataggattatagaaagaatcctttaaacccatctttgtccagagctgcttagataatcctcatttttctgaacttgttctgatcacgtgggaggttttaatgggattctcattccgacgaccaagatacacatgtgccaggtgtataactgct

SEQ ID NO: 569 - DNA, 508 bp, Homo sapiens
tggaaacatattgaaagaacacactcaaaataatattcagcctcgacaccttaacaatttcaggacacaatggcatagtgctcattcttggcaaggatgtgaggaaataggaattgtcataaacttttggagggagtgtagattgatagctttcttttttagagcaacttctaaaatctatcaacattttaaatatacaaatatcaccttaggttatttcatgcctagaaatgtatcctacagagatccattcacacaagggctcaaagatacgtgagcagagatattcatttgtaatcatgtttatcacatttttaaaaactggaaataaccaaaatgtccactaatgagttaaatagtatatggtgtatctattatgtggtatactacgcaacagtttaaaaaagtaacatgaaaatctgtgtacatgaactgacgtgaaaagaagcccacagtcattcattaagttagaaacacaagttttcaaacagtatgaactaaatcatga

SEQ ID NO: 570 - DNA, 427 bp, Homo sapiens
gtctcatccttcctggggtcacctcccagggcagccacctttgccagaagtgcccaggtttgatgctccagcctgggctggcatggccagcagaaagcacaatgtcttggaggcccagcagaaggaagacatcagtctctgaacattgaaaaggggcaggtgaaagtgtagggcgggaggaataagtcccttcgattcctccaacggtggctggcaaaacagaccccatctccctggaaggctgtgccctaggatgggagggttgcaaaatggaggcagctctgtctctgttctagtagtggagacctggatgacaccactccccagatgtccaaggactggggggcctctgggggcggcatttgaattaggccataaacgattaggagaatgtcagaggaaggaagtggtaggggaaagggggcat

SEQ ID NO: 571 - DNA, 183 bp, Homo sapiens
ctctgctggttgacaaaaactagctccctaaaataatgttacagacataagtaagaaatggattgtggtgacacataagctgttaaagaaacccatagcctaatttatagtgtatcaggtttgcaagtggtttaaaacaatagcggtttactgaatgttcttactagcgtgaggggagagctt

SEQ ID NO: 572 - DNA, 388 bp, Homo sapiens
gttcttcagcccagcaatttaactgctggaaactaatctagagaaataaaagctgcagtgagtgcatagatcagactctgcccagggttgcctgagagccagtggagccacgctggaccgtgggccttggccatgtgagccacccagcctgcctgtctctcctgcagttctcgtgggcctaaggtctcaggttcccaagactgtgacatgaaccgggctgtgaggcagcaaaactaaccctacacaccctagaaactccatgtgcctctgtcctcctgaccttgtctctctggggctggggctggattcgcctgttaatgaccatgtcctgggcctttatgcccactgttttttttgcctgctccgctcagaggggtcttggcctcat

SEQ ID NO: 573 - DNA, 477 bp, Homo sapiens
ctgtaaggggtgtggaggggatcacagcagtcttgactgtttttttgatttctctgcgaggtagctaataggaactctagtttacagaggaggacatttaaagttcgatgccctgggccacaggctggggaagcattgatttgaacccaggtcacttgtgttagtgtccttaggctgtggtaacaaatcactacaatccaggtggcttcatacagcagatttatcatctcacggtgctggaggccagaagtctgaaatcaaggtgttggcagggttggttccatctggtggctcagcgagagaatctgttccacgcttctccctcttggaacagcttctggtggctgccagcaagcctcagcattcctggccttgtagctgattcacacccatctctgtgtctgtgttcacagaggtctccctctgtgacgatctgtgcctaaactccctctccttttcgtttataaggaatgcatt

SEQ ID NO: 574 - DNA, 272 bp, Homo sapiens
tccctgtttcctgcacccagctttttccagcagggggcaccagagatagactggaagcagaactcctcccaagcccattcttgcacgctagctcagttttcagcccggagagcctcctttcccaggaacttttctcccgtgtgggggggctgctcagaactcctgttaggaagatgggtgggggcgctgcccagagggtgctcactcctagggagctgggaaggaggtccctggataactcctggacctccccggtgctgctgctgacaacc

SEQ ID NO: 575 - DNA, 549 bp, Homo sapiens
catggcatatcacagcagaggcaagaaaggctgactaggaccaaggaaaataggactttatacatggatgtgtccacatgtgtacgtgtgtataatgagagatatatcaaaatttaagaaatccttctacccatatcttttccaggctttccaattttccgcatttcacatctcagcacctaagtataagaacttgcatggaatagatactcagtaaaacttaagtgaattaaatcatatttttagggtaacagctccctgaccctgcccacacacatataccgtcccatctgtgactctactgttatttgtccatcttcttgctaacatgagaactgcatattcctctagatttccctgtagatttccctattgcagggagcaataaatagcactgccttcacctgcaagcccaggttggaactagtttcatcactagggtaatgcccaacagtcatagccactgagctgacaagactgacttcccatctattcttccccaccccaccccccgccaactacatacagtatctaggtactataatcagc

SEQ ID NO: 576 - DNA, 315 bp, Homo sapiens
taatgtgtttttatgcccactatacacacgcagtctccctggataaaactttgtctaagtgtttcaggaggctgctcaaaggaaatgtggcttgttttgggaggtctgaaatgttttcagatttgctgtcttgaaaaaaaaaaaacagacatatgggatttcttcatgcaaaaatcccatcacatgtggctgttaagatcaagaagacagtttacctgcaggatatattttttccttttcttcgtacctaccccggaataacttttcaggtcctctcacagaatgaagcagtttccttaggaactaaaaccgaga

SEQ ID NO: 577 - DNA, 2234 bp, Homo sapiens
aatgcaaggattgttcaacatacaaaaatcaatataatatactacattaacagaacgaagcgagaaccagatgatcatctcaattgatgcagacaaagcatttgacaaaatccagcagcctcttgtgattaaaaacactcaacaaatgagggataagaggaaactacctgaacataataaaagccagacatgaaaagcccacggtagacaccatacttagtggtgaaagcttttcctctaagatcaagacaatgctcatttcaccattcctattcaacacagtactaggagttctagcctgagctagaaaaagaaaagacatctaagttggaaagtaagaagtaaaatcctatatgttcacaaatgatatgatctttagacaacccgaaagattccacaccaaaaaaaaaaaataactgttaattcagtaaggtagcaggatacaaagtcaacccacaaaagtcagttgcattcctatacactaacaatgaacaacctgagaaggaaattacaagaacagtcccatttaccatagcgtcaaaaagaataaaatgcacagaaattagcttacccaaggtggtaaatggcttgtacaatgaaaactacaaaacattgcttcaataaagataaaaataaacggaaatacatctcatgttcatggattggaaaatctaatgttaatatgtcagtactactcaaagtgatgtgcagattcactacagtctctatcagaatcctaggatttttttttttttttttgcagaaatagaaaaacccatcctgaatttcatgtggaatctgaagggatcccaaatagccaagtcagtcttgagaaagaagaacaaattggaggacttaaacctgcagagtttaaaacttactataatgctacagtaatcaaaacaatgtgattctggcataaaggcagatggatagaccaatgggatagactggagaacctagaaataaaccctctcatatgtaggtaaatgatttttgacaagggtgccaaggctattcaaaggatagttttttcaacaaataatgatgggaaagctggataaccacatggctaacaaagttgcaacctcactcatttgcaaaaattaactcaaaatggaccaaagacctaaatgtgagagctaaaaccataaaactcttaggatgtggcagtggtttcttggatatgacaccaaattcacagacaacgaaagaaaaaataggcaaattatacttcattaaaattttgtgcatcaaagaacactatcaacagagtaaaaagattacctatggagtgggaggaaataatatgcagttcacgtacctaataaggattaaacatccagaatacatacaaaactcccaaaatgcaacaacagtgtaaaaacctgatttaaaaaatggcaaaggatttggatagatctccagagaggacatgcagatagccagtgagcacaggaaaaaatgcttagcatcactaaacagtaaggaaatgcaaatcaaaaccacattgagataccacttcatacccactgggatagctcttattaaaattaaaaaaacacacaagtgttggcaaggatgtggagaaattggaactcttattactgatggaaatatagtggtatgcagctgctgtagaaaacagtatggtgattttccaattaaatatagaattgtcatttgattcagcaattgcatttctgggtatatacacaaaataattgaaagcggaggcttgagggtatatttgtataccagtgttcactgcagcattattcacagtagtcaaaaggtagaaacaacccaaatacccaacagatgaatggatagacaaaatgtgttatatccatacaatggaatattattcagccataaaaaggaaatccttctacatactacatcatggatgaacctttcagacattaagtaaatcacaaaaggacaatactatatgaatccactgatgtgaggtacctagactagtgagattcatagagacaaagtagaacaaagattacgttttgtcacagggggcaggagggaatgggaatttattgtttaaggggcacagagattagtgtgggatcatgaaaaagttccggaggtgcatagtggtgactggtacatacaacgaatgtatttaatgcctttaaactgtaacttcaaaatggttaaaatttaaatcttacgtacattttgccacagtaaatttttaaaccaccaaaaaaaaa

SEQ ID NO: 578 - DNA, 1619 bp, Homo sapiens
ccggttttttggggaaccccgtgtcgacagggttcctgcccgtggccaggtacaatactatggggcgcggcgccacggattgtttaaaacttcctcagagccaagcgtccgaacaaagtgttatgtggtgagtgttagttgtttgcggaataccacggaagttacctttaatattgggaccccatattaagggggaagaaataaatccaataagttcgcagaaataaggtaattttggtgtaaaatggtaacgttcgtaccctatgcccacaactgagaccggttaccagaacatgggctactccaagtaggaactggccgaacccataagtatcaccttaatattttggtatggaccccttttttttttttgagagagccctgctcttggtgccaaggctattcaaaggatagttttttcaacaaataatgatgggaaagctggataaccacatggctaacaaagttgcaacctcactcatttgcaaaaattaactcaaaatggaccaaagacctaaatgtgagagctaaaaccataaaactcttaggatgtggcagtggtttcttggatatgacaccaaattcacagacaacgaaagaaaaaataggcaaattatacttcattaaaattttgtgcatcaaagaacactatcaacagagtaaaaagattacctatggagtgggaggaaataatatgcagttcacgtacctaataaggattaaacatccagaatacatacaaaactcccaaaatgcaacaacagtgtaaaaacctgatttaaaaaatggcaaaggatttggatagatctccagagaggacatgcagatagccagtgagcacaggaaaaaatgcttagcatcactaaacagtaaggaaatgcaaatcaaaaccacattgagataccacttcatacccactgggatagctcttattaaaattaaaaaaacacacaagtgttggcaaggatgtggagaaattggaactcttattactgatggaaatatagtggtatgcagctgctgtagaaaacagtatggtgattttccaattaaatatagaattgtcatttgattcagcaattgcatttctgggtatatacacaaaataattgaaagcggaggcttgagggtatatttgtataccagtgttcactgcagcattattcacagtagtcaaaaggtagaaacaacccaaatacccaacagatgaatggatagacaaaatgtgttatatccatacaatggaatattattcagccataaaaaggaaatccttctacatactacatcatggatgaacctttcagacattaagtaaatcacaaaaggacaatactatatgaatccactgatgtgaggtacctagactagtgagattcatagagacaaagtagaacaaagattacgttttgtcacagggggcaggagggaatgggaatttattgtttaaggggcacagagattagtgtgggatcatgaaaaagttccggaggtgcatagtggtgactggtacatacaacgaatgtatttaatgcctttaaactgtaacttcaaaatggttaaaatttaaatcttacgtacattttgccacagtaaatttttaaaccaccaaaaaaaaa

SEQ ID NO: 579 - DNA, 414 bp, Homo sapiens
tgaaatagggctacaaatggattgttcccaggactggaatttcagagaagctaccttgggcttactcgtgacccaacatgtgtcagtgtctccccagactgacggtgtgaataaaaagtgctttcggcttgtaaatatcaacattataaagacacctctaaataaacatttgacatagtagcttccataaattgccaaatctttttctaagggttgccccccttttcttaccggattctatttcatagtctggttcaagtctccctagattttcctcttctaaaatagaaacaactgctgagcacggtgagatgcgcctgtagtcctagctactcgggaggctgaggcaggaagattgcttgagctcaggagtttgggactagcctgggcaacacagcaagacccagtctctta

SEQ ID NO: 580 - DNA, 272 bp, Homo sapiens
cttaaagatcctagggatacacaacactcctggaggtcatacacaggaggtcagaaagagacttgggggccagtgcctttagtggggtcctgggtgtcacccaagcaggtttcacgtggggattttaactggtgggtttaacgcaagcaagtggccgggtgaggtgactcacgccggcaatcccagcactttgggaggctgaggcagatggatcacctgaggtcaggagtttgaaaccagcctggccagcatggtgaaacccctgtctccac

SEQ ID NO: 581 - DNA, 433 bp, Homo sapiens
tatatttttatatatatatatatatataatgaaatactattcagccataaaaaagaatgaaattatgtctttgcagcaacatggatggaattggaggccattatcataagcgaaacaatgcagaaacagaaagtcaaatactgcctgttctcatgtataagtaggagctaaataatgtgtacacatggacatagaatgtggaatgacagacactggagacttgcaagggtgggagagtggggaggcatggtgagggatgagaaattacttaaagggcacaatgtacactattctggtgatggataaactgaaagcctagacttctccattatgcaatatatccatggaacaaaactgcatttgtaccccttacatttatacaaaaaagtgattaaatgaatgaatgaataaataagcatataaacaaaccaaa

SEQ ID NO: 582 - DNA, 325 bp, Homo sapiens
ttcacagctattaaagagcaggaataaacctatggttgttccaccaaccccatctctctcctctgctagaattgcatgcctaggaagttgctccgtaagcatctgtttaatccaaaggactttcagattttctcctctgaataagatgccctatcagaggaaaaataaattattgtaatttggctggaacatctcctaatattccaaaagacaccaggacagagttggactaagcctgaactttatactggaaaagcctcactcaatttcccctctgtcactatctgctgtttactattttgtgttttttgtttgtttgtttttg

SEQ ID NO: 583 - DNA, 355 bp, Homo sapiens
ttttttgaaaaaacaggggttttgttttgtcacccaggctggtctaaaattccaggtttaaagtgatactcccacctaaaactcccaaagcgctgggattacaggcaggagcccctgtacccagctaacactgtttcattttaaatgaagtgttttacaactactgtaacaaggagacaagccatacgtgcatatatgtgactatatggagagctggaagcataatgacctaagtaaagtcccagtggaagaagagatgagagatggtagacaattagtgagttcacttgacttaatttacaatataagcaattaacagttataacttatgaattcttactatttataatacttg

SEQ ID NO: 584 - DNA, 564 bp, Homo sapiens
ttgtatttttagtagagatggggtttcactatgttggccaggctggtcttgaccccctgacctcaggtggtccgccctcctcggactcccaaagtgctgggattacaggcgtgagccactgcgcccggcatacgtttctattcttaatatcatgcatttaaaaatacgtccactgtctagattatatattttctcctgacacttcagagttcagcttttcttatatttgtatcttcttacctacttagctacaagggaaatggttaaagaaatcatgcagtggccaggtgcagaggctcacagctgtaatcctagcactttgcgaggctgaggctggtggattgcctgagctcaggagttcaagatcagcctgggcaacatggtgaaaccctgtcttgacaaacaatataaaaattagccaagtgtggtggcatgcacctgtagtcccagctacttgggaggctgaggtgggaggtttgcttgagcctgtaaggttgaggctgcagtgaggcaagattgtgccacagcactctagcctgggcaacacagtgagaccctgtgtca

SEQ ID NO: 585 - DNA, 418 bp, Homo sapiens
ggaatggtggctgccaccaaaggcaacatggtaggacagcattcgccagctgcagctaagtccagccagaccagagagaatgacatgaacatgtgcatgataaatcctgtctgttggcaaaattgaattaccttaagaagaggatatgcaactcacatgccaaatctgatccactactgctatgatttccaaggtggagccaacaggaaaatatatgggatcaatcatcaatgtctgccataggaatggggaaagggaattacaacatgtgtgccaaagacctgtgacctcaccaacctaagattaaaaacaaacaaacaaaactctgcttctatatgtttgtttgtttgtttgagatggagccttgctctgttgcccaggctggagtgcaatgacttgatctcagctcactgcaacc

SEQ ID NO: 586 - DNA, 322 bp, Homo sapiens
aaagatctctcaaacacatttttaagttaaaaaagcaaaatgcaaaactgtacataatatgctgtattatctataaaatagagcaaataagaattataggtatgcttacttgtactcatataaagaaactctagaagaataccaagaactgtggatgagggtagaatagtgaatggaaactgactgattagactaaagaggtgggagtaagaccttttatgtatcgctttacattatttgactttaggaccatgtggatgtttgcatattcaaataattaattcttaaaaagaagatgaaaatagaaggtgggcgcagtggc

SEQ ID NO: 587 - DNA, 422 bp, Homo sapiens
aagtaaaacagctataagagcactgaggttcttgttgaaataattttaccttaatgaattaccaagaccttgtaagaaccagaatggggaccttacaggtcatgcactcaggaatattaaaaggtcatcttctgggggactttataatcaaactttaagaaaaacaaaagttgtattcctagtgtctgcacacagccagaaaaagattttctgctttctggaaagttgagatggtaataacatttctcagcatgtaacatctagttagtagaaagagtggttgacagctgagactaaagatattaacctgaaacaaaacacatcataaatgacaaaatagttttatcattaatgcatgaaaactttaaatagtacgattatttctaaatactgcttttaataatattgtgatacaaatttta

SEQ ID NO: 588 - DNA, 471 bp, Homo sapiens
aaaaaccctaggccacagctcaattcttccttttaagaaaaaaaaaaagaagcaggaaacaatctgagaatgaggagaaaacaaggagaatgaccccctttagagcaccttattggttttatggcacctctatttgccagagtaaaatggaagtaatacagtctttgtgcaaatttacattgaggaaaaagagccctaaggtcaacctgcaaattctagagttcctagtccgtttttctctattttcctttctgccatgctttaagtctgctgttatttttccactgagataaaaccactgtttgggtctaatagttttttgggtttttcttgcaagctggcaaatttgtatttatctcatggctaaagtactggagtaaaagttatagaatctgtatgtgtgtatgtgtgtatgtacatgtacacatgtatgtatttgaaggcctttatgatagatgtctataattttat

SEQ ID NO: 589 - DNA, 365 bp, Homo sapiens
agtgtcagaaagggggcaggatgcagagtcatggcactgaggtacagatgtctacttgctctgtgactgttttgagcctcgttttccctgccagcaataccaactttgtaggatcattatggggatttgatgagttagggggtatgaaggcagtttgtatattgtaccactgtatgcatcacctgccttttctaaatggaaatttgttctcacaatcgtagatgggtggagatgttagggctaatagaggccctttaacctgacataagttaccatgccactttctagggtgagagcattcagtgactctcccttatgctctgaataggccctatgtgcttggatttctgccaagctcttcaaca

SEQ ID NO: 590 - DNA, 331 bp, Homo sapiens
tgttttcccccaaatcatttggcagaaatgtggctgggagcttcattgctgatgttttcagttttaatattgctgtggaaagcctgtaccaacactcagccatgttattcatccacatctccagtctgggctgtgatttgtttttcctttgagtgacacaaccttattttccattaagactcaatgcaaatagacactcatgcaccatcaccatcactccccctgcttggctgagggaagtcaatggagtgattctagtttggtgttcatattggagggttttatttgtttatttattttgagatggaatctgtctctgtcaccaggctgg

SEQ ID NO: 591 - DNA, 598 bp, Homo sapiens
caacacggcagccctggactcagcccacagggtgacagcccaagccccttgcggcagggtggggctcagggggagtcttcaaaagaaaagcccaggcgtgcccttctcgaccttcctgcctggaatgcagatgaaacagccggggcaaggcagccatctcgagaccagcgagccacagctaggacagaagccggggccggagcatgatgtcggaggaggtcagggtctctgcggcatggcagggaagtggccgccaccctgaccgcctgattgctaacaggaggaagatggatctgctgttcgtgaaagtgcttgcaaaggcagagcctgctcctcacgggagcggacctggggagctgtgtgataagcagcaggtatttattggtcttagtccctggttcctgacacaaagctcataaattccttgtaatttcctgagtgggaagggtgacaggagcatcttttgttctatttggttcttgtacaaagttcttaaaaccttacattttcctggctcggcgcgatggctcacgcctgtaatcccagcactttgggaggccgaggcgggcgggtcacgaggtcaggagattgagatcat

SEQ ID NO: 592 - DNA, 300 bp, Homo sapiens
gtaactgggagtgatagagagaagagggcgcaatagaagatcagtgtcatttgaattgggtataactttttttttttggtaagagtacaagtatttttaaaatttgagacaggaataagttaacttattatttacctgcctctattgttcatttaaaaaaatcaagatatacattaggaaaaagttttatgttaatattaccataattactgatcaagtgccaatgtttttgagcagcatttcaattgtaagtttgataaatattgcctctaacagacacatggaaaatgatcaatacta

SEQ ID NO: 593 - DNA, 325 bp, Homo sapiens
ccaggcatggtggcggacacctgtaatcccagctactcaggaggctgaggcaggagaatcacttgaacctgagaggtggaggtcgcagtgagctgagatcacagaattgcattccatgcctgactaatttttgtattttcagtagaaacagggtttcactacgttggtcaggctggtctcgaactcctgacctcaggtgatccatctgcctcggcctcccaaagtgttaggattacagccgtgagccacgcgctcagcctcatctccattttatagatgagaaaacaagaaataaagtaattggtccaagaccaacagccagcaa

SEQ ID NO: 594 - DNA, 419 bp, Homo sapiens
gcttgcacctgtaatcccaactacttgggaggctgaagtgggaggatcgcttgaatacgggaggttgaggctgcaatgagctgtgattgtgccactgtactccagcctaggtggcagagcaagaccctgtctcaagaaaaataaaaaataacaaacttgaggcagagcatggtggctcacacttgtaatcctggcatttgggaggctgagacaggaagatcgcttgagcccaggagttcaagaccagcctgggcaccataggaaggcttatctctaccaataaaataatttctttttttaattaaccaggcaatgggcatgtatggtcccagctgcttggaaggctgaggcaggaggatcacatgaggccaaaagttcaaggctgcagtgagctgtgatcttgccattgcactccagcc

SEQ ID NO: 595 - DNA, 267 bp, Homo sapiens
tccttctctcgctaactcactggccagctgcaccttgaagaggtggggctggaggtccattttcacttctgaaggtcacctgggggcatctcggaggcagagctggggtctctgcccagggaggctcctgtctctacacaggaggggctccccgtgggaaaggggattggaagctgcgtttgcaaaaccaggacagaagaataggaccacccacaaggaaggaagggcaggagggagagggtggtgccccttcctccctgcagcctg

SEQ ID NO: 596 - DNA, 435 bp, Homo sapiens
tgaaaaccactgatttatgccaacattccaaggtaaggagctacgggggtaatgaaatttgagtagaatgaagtctcactggtatggggaggatgaatttcttgacacactggtgtcatggaaaagagcccaggttttgggctgggtgtagtggcgcatgcctataatcccagcactttgggaagccaaggcagaattgcttgaagccaggagttggagaccagcttgggcaaaaaaagctagaccccagtctctacaatttttttttaattagccaggtgagatggtatgtgactgtagtccgagctactcaggaggctgaggcaagaggattgcttgagcccaggagttcaaggctgcagtgagccgagattgggccactgcactctagcctgggtgacagagggagaccctgtctcaaacaaacaaacaaaa

SEQ ID NO: 597 - DNA, 250 bp, Homo sapiens
agaaacaaaaagaaaaaaaaggcagacataacttttctttttttttctctcagtcccaccatcccaactattttttccctagttaggactccacactatcaacaccttgattttagatttctaccctccagaactgtgagacaataaatttctattgttttaagcacccagtttgtggtagtttattttggcagccctagaaaactaatagagattttggtattgggaaatgggatccttgctgtaacaa

SEQ ID NO: 598 - DNA, 415 bp, Homo sapiens
cctgaaagctctctttcctttataaaaatgttttacaagactactactaatcttcatcacacaaagcgctattattctggttttatagatggatatattgaagactatacaagtttgtaatttttctcttccttcaagatcaggaatgaatgatgagtgcctcaggtcatatgaagctgtacaagatatatgctcccagtaaggtcacagtacgtcaagagttgggtctattctctacttcatcattttccccaggggctcacagactcactggaaaaatttacacttaaccaaactcacaagaggttggctcataaaccataatatcaactccaaaattcaaaccagaaaatatatttagcaggtttcttttggaagattctctgcactaacacaattacagaaaagagaatga

SEQ ID NO: 599 - DNA, 384 bp, Homo sapiens
aatttagaggtgggaaaatggaggttcatagaagttgaattgtgtgactatgaataagtaatttccttgaaggtgcgttggaagcagagttcagatttttcagtcttaagccagatctctaccctctcttctcgattgcctcttttcttgctgttttgaaagcagtgatgagactttgattttatttagatatttataattttcttatagcattatgttaccatcatagggcatatcagtaatagtaacatactacatatgtcaatgttagacatttaatcacctctagcaacctacaagcaaataaagagacaaaactcctctggaccagcactgtccaataaaattataatttgagccacatatgtagtttgaaattttcct

SEQ ID NO: 600 - DNA, 370 bp, Homo sapiens
gagcaattaacagcagcactgctccaagtgagagagtcttagccaccaagttcacctttagagcttttggataaggcagatgcccacatcctaccctagactagggaatccaaatctcagttgcctggtaaagaaaggctctcccagcaattctggtgaccacctaaggggaggccaccgtcacctaattggcagcataagtatttgccaaataagcataacaggataatgagatccagcacaggggttagctcaggcactgcctctccacaaactttccctgaacttcaggtccaaccaagcacctatgttctcacagcaatcttctccaatgcatgcttttctttcttagtatttatcatgttatatt

SEQ ID NO: 601 - DNA, 499 bp, Homo sapiens
gcattttgcatttctaatgtaagggagatgtgagaataagagtcagtagtaggagtaggagatgtgacaacagaagcaagtgtttggagtgaaagaaggaagagttcatgagccaaggaatgcaggcagcctttaggaggtgaaataggcaggaaaacagattattcactacagtctctaggagaaaacagacttgacatctacttgatttatctcacctaggggtgtttgccagcacctctactaacactacattaatacatttgcatttcccaatgaagaaggttgaaaggtataatgtataatttccatttggatcttcccattaatgtaatactcatttccactttctcttctattatctctctcaatcatttccctatgtttctatcaccttagaggttttgctgccatattacttgataggaaaataacaagttttaatacaagatgtgtgatatgagcccaatattgtaataaacatttaaccctatatgta

SEQ ID NO: 602 - DNA, 386 bp, Homo sapiens
tccccagctaataggtgtaacaggataggcacttagttaatacaaattaagccaaagcacaagtcaagtgttaaagagagcttcatggcagtgctgcattgcctcacttatccagagagccagtagccaacctatttagacagctgacagtaagaaggaagcaaatgagacctcaagccaggccctttctcagagccttaaacttttattttagggatggtctactgagcttaatgatgtggtttttctaacccttagcagataaaagtgcaaattcaagctggaataggggattgctagaagcaagcataccaacagaagcagagataaacttgattgtgagaaaggaagaaaaaaaaactgggaaaagcagagctcagagctga

SEQ ID NO: 603 - DNA, 810 bp, Homo sapiens
ctagctgagacgactctcttaatttttccaccgctacaggatcatgaacatttgcagtcactgtttctgatgggtgttcattgtcaacaagcgaatagatttctgcatctctccgaaatagtcttcgatgtttttgatgatgagggagtgttctttgcgacagccatttcctttgatcacttaactgtgtgggccgcacggtctcgggtctgtcccttcacgctccatgacaaccctttacccccaaactgtgaatcacccaaatgtctgccagctggtgagggataaataaccgtggtacatttaagcaacggaatactactcagcaatgaaaaagaacaagcgacagaagcgttgagaaaacatagataaggcctgaagtgtgacgctgaaggaagccagacacaaggggacacgttgatgattccactgatactcagtttctagactgcattttaaattgatagattttcagcttctcagtgggacacactaagttacgaagtacctggttaccttaattctttctcaactgctctttgattttctttttattttctatataaacttgctcttttccttttagagctttttctaaaaggaactcttaacttccatttaaaagctctgtgatcagcagtagaagaaataaatgatccgttaaccagccattctaatcaggggtagcgttaaaagctttttcaccttgctattttgaagacgtttacttctttaaacaaatgattccaattaataaatacagaggcggcccgttccttaagggaggtataccatgaccctcctcctggc

SEQ ID NO: 604 - DNA, 1025 bp, Homo sapiens
ctacatacatctatttttctatatctaatctatgtatatatatatataatctatgtctacatatatatctaatctatgtctacatatatatctaatctgtgtctacatatatatctaatctgtatagctttgtctatatctacagatccatatttatatctatatcttatccataccaatatctatatttacatatgtattagtaatatatatacacacaccgtaaaatctaaagtatttttttatttgttaaggatcatgaacatttgcagtcactgtttctgatgggtgttcattgtcaacaagcgaatagatttctgcatctctccgaaatagtcttcgatgtttttgatgatgagggagtgttctttgcgacagccatttcctttgatcacttaactgtgtgggccgcacggtctcgggtctgtcccttcacgctccatgacaaccctttacccccaaactgtgaatcacccaaatgtctgccagctggtgagggataaataaccgtggtacatttaagcaacggaatactactcagcaatgaaaaagaacaagcgacagaagcgttgagaaaacatagataaggcctgaagtgtgacgctgaaggaagccagacacaaggggacacgttgatgattccactgatactcagtttctagactgcattttaaattgatagattttcagcttctcagtgggacacactaagttacgaagtacctggttaccttaattctttctcaactgctctttgattttctttttattttctatataaacttgctcttttccttttagagctttttctaaaaggaactcttaacttccatttaaaagctctgtgatcagcagtagaagaaataaatgatccgttaaccagccattctaatcaggggtagcgttaaaagctttttcaccttgctattttgaagacgtttacttctttaaacaaatgattccaattaataaatacagaggcggcccgttccttaagggaggtataccatgaccctcctcctggc

SEQ ID NO: 605 - DNA, 293 bp, Homo sapiens
gacagcaagtattgatgtatctaaacatatctaaatacagacaagatacaataaaattcccatgtaaaagataaaaaaggagcctgtaatcccagcactttgggaggccaatgcaggaggatcacttgaggcaggagttcaagaccagcttgggcgatatagtcaaacccctccaccccaactatctcttcaaaaaaatttaaaaattagccagatgtgctggcacatacctccttgtggggctgaggtgggaggattgcttgagcccaggagtttgaggctgcagtgagccg

SEQ ID NO: 606 - DNA, 471 bp, Homo sapiens
caaaactccatctcaaaagaaaaaagaaagaaagaaagcattcaggggagtgggagccagtgttgcaccggatgtagctgagaggtcaagacaagcaggaggtgtgatgttggacccaacaccatggggaccccgacaagagcatttccagagtaggaacagcaagatgtgaacatttgattggaaatggtgtaagagagaactgagaacgtctcttgtgagaaattttgctgtaaaaggaaacggagaaatggggctggagctggaggaagtccagagagtttttgttgtgattttgttttaatgtggaagaagtgacgatgtgtctgtgtgcccgtgggaatgagtacgtgggggctggggacctgctggagcaatgaccttcaggaagcaagagaaaatggggaaaataggccaggcacggtggctcaatttgggaggccgaggtgggcagatcacttcagcccagga

SEQ ID NO: 607 - DNA, 600 bp, Homo sapiens
agaacagctttttgagagaagcttctaaaaatgagacacagacttggaacacagggagctttggaccagagagatgaggagctgggaaagatggtcgatagaggtgggagatagtggccaacttcagagctttgaacaactttacccaagtgcccactttggtcacttttctcccccattacatgggaagacccctgaagacgcgggctatgtcccctctttccctgaaacttgcccaccatggatattcagtctgtgttttttattgatccagttatgggcactttcagcattgttcagatgattgcttgatggggagatcacagcagtggaagtgacagctaacagggaccccacttaaccagggaggaaaggggactctgagggactgagtgatttgtccaaggtcacagagtaaagagatggcaaagccagagaaggcattggttttgagtccggtgttctttgagttcactgttcacctctctcctgcccttgtcctcttgggagaagaagaaggtgttcaccgattcctgcccacccccacatacagtgcaatggggggcccccagagacacttcccaggtcactggttgagga

SEQ ID NO: 608 - DNA, 457 bp, Homo sapiens
gaactctgagttctcctggggagaaacaaaccttttaaatcatcacaagcagctcccctgatctgcggcaccccctctccaatgccagaagctgccccctcttccaccaccctctcctgacaatccaaatagaatgagcaaagcggtttttttcaccctacgttcctcaggccagatacattctagagaattgtgagactttgccctaagctgccaagtgctccccaaggagatcggtcaccaggagagcagccacaaaggtcaagaaagacacacacggaagcaaacccaggctctgtgctccttccagcccttgctggtgcagatgctaccccacaagcttgtcagatcgcccaggtgacgggccaggcgcagccatcgggaaggtcattcagccaacccagaggatgtagaccctgtcctcaagaagtgcagggcgagttctgccgtgccctct

SEQ ID NO: 609 - DNA, 143 bp, Homo sapiens
caaaaaaaaaaaaaaaaaagagagagaaatagttatttctatgtagaatggcggaaggaatttaatggaggtagagatgaaagctgttgttaaaaatgtaaaatggggctggtgtggtgactctcacctgtaacatcagcact

SEQ ID NO: 610 - DNA, 417 bp, Homo sapiens
tttaatatgtgagaaacctgagctctagggagaagataactaatttcctctacacaacctggtggaggtagggatagaactggcttcttaggctcttctttatattgcaacaaattgcctctcatcaaacaaactttttaaatagtctcttattatattcctgtgttccctgtgaaatgtaacatttataatcaattgacaattataagatttatatcattagacgagagcagtatattatggtgaataaaatcacagcttctggtgccaaaaacagctatgtttaaattctggctctattgtctttttttgtgacttggacaagttactaatttttagtcgcctctgttttcttttgggtaaaagaaagagcacctacttcacatattgcttgtaaaaattaaattagttaagcca

SEQ ID NO: 611 - DNA, 779 bp, Homo sapiens
tcactgcaacctccgtctcatgggttcaagcgattctcctgcctcagcctcctgagtagctgtgattacaggcgcctgccaccatgcctggctaatttttttgtatttttagtagagatggggtttcacgatgttagccaggctggtctcgaactcctgactgtgtgatccacctgcctcagccccccaaagtgttgggattacaggcatgagccactgcacccggccccaactgctcttctttcagttcctcaaatgcatggtgctgcttcctgcctcctggactttgcacgtgctgtgccctctgcctggaacaccctttaccctctttacccggtccccccagtaacttgtacttcctctgtcacagccctctttatgctgacctgcagcaaaccaagcaccctgtgggtccagggactgtgtcatgttttctgccatctccctgaacctttgtaaacacaaaagcacaggcattactgccccagggaccttgatccaaactccagctctgccacttaccagctgaggaacctcatgcaacctcttccgtgattggacctcagcttcctcatctctgaagtgaggatcacagcaccagcctccccgtgctatgtgaccacctttcataggggaatgacacaagatctgtgctgccctcacacatgggggagcagcaggggcttgcatgggccaatatgggcattctttttttttttttttttgagatgaagtctcactctcttgcccaggctggagtgcagtggcgcaatctcagc

SEQ ID NO: 612 - DNA, 429 bp, Homo sapiens
aaaatttttaaaatttaacaattagccaggcatggtggcatgcactgacggtcccagctgctcagaaggctgagctgggaggataacttaagcctaagaggtcgaggctgcagtgagccatgttcataccactgtgctccagcctgggttacaaagcaagactctgtctcaaaaaaaaaattttttttgcatatatgttacactgtattatatgtattatgtatgtatagatatttgttagcacaaaatattaaaatggactagaaagcttggttctggataagatggcctgaacacaccctccagtctcgcttccactgaatgcagctataaattccaaagagaatacatgaagcagctatttgaggactctgaaaagtaaacagtagcaggcagataggggaagaagatcaaaattttaagaaccac

SEQ ID NO: 613 - DNA, 430 bp, Homo sapiens
gaaaggtgaggagaaagggatagagtaagggggcaggaccttggcctcccaaagggctggaattacaagtgtgagccactatgcccggccaactttaattctttacatcttcggcacatttattttctgattgctctgtatgaaatcaaatccagccataactttattgctagcatgcttcagttatctatttctgtaaacaagccagcttagccgcagtagtataaaacaaaaactgttttattatgcttctggattctgcagtttaggaatttaggcagggtatggcagggatgcctggtctctgcatcatgatgtctggggcctcagctagaatggccaaggcttcaatagccagggagactcaaaagattgaaatctaaaatcctctgaaggcttctttactcttatgtctgtatctgggctgaga

SEQ ID NO: 614 - DNA, 261 bp, Homo sapiens
gcaagaatcctgttaaatcagtttagacagaatcctccacccttaatatctgatcaccttcagtatctgaccaaattcttcctctctcaccatctcccaggtaatatgggatcactgtggcctgtcttcagtaagaatcttgttaggtcagcttatcaagaattatcttacccttgcagtagtttttaaactactgaccctccacattcttcttcttggctataaatttcctcttgtggacattcccaagaatggtcgacg

SEQ ID NO: 615 - DNA, 439 bp, Homo sapiens
accaaaaccatttctgaatggggagtggggaaaaaggaggaagaagtattaagagagcaagaattctacaaaatcaggatgctaaagaaagggactttcaaaaggggggattttagtcccgtcctgcattatattttacatgttttgggcttatctgttttccttttaaaataaaaatatgtttctatattgttagggcaacagttgttattgttactttaacagtgttcaacactgtgctgaaggtactgctaaggacattgttaggcatttaataatacttgcttattgattaatttttataatatccaaataatgataaaaaatctcacttattacatttataatgagcagttctaggtgcattacatggatcatttatttaatccccacaatgagcaaatgaggtaatgttcattatttcaatgaaggtagaata

SEQ ID NO: 616 - DNA, 277 bp, Homo sapiens
tgtttgacagagtcttgctctgttgcgcagtctggagtgcggtggcatgatcctagctcactgaagttttgaattcctgggctcaagcaatccttccacctcaacctgccttatttggacattgtgtgatgagacatttggcttatttgggcatgatgtgatgagttggctactgtgattggctaaaacctggggttcctgtgattggctaaaattccgtcattttttatactcttatgttaggttttagcttgtttatttattcagtttatggttt

SEQ ID NO: 617 - DNA, 279 bp, Homo sapiens
actatgtgttttgttatatttacatccaatgaattaatttctggagcaattgtaaataatattatattttaaatttcattctccatgtgtttattgctagtatatagaaatgaaattcagttttttaaaaaaagaataagacttttaatggcagttttatatttacagaaaaattgagtagaaagtacagagggttcccatcccaccacctacacagtttctcctattattaacatcttgctttatcttggtacgtttgttacaattgatgagccaaca

SEQ ID NO: 618 - DNA, 488 bp, Homo sapiens
ttctgaagttccttgcgtctgaatgtgtgctatactgcttgacttaatttcttacaaaagattgtcaagagatacttcttttcaagggcacagtcgaatgatgaccgtccactatcaggcattttgttatcagcacttgtgggtagtgtcaacagggatctcttggctgctgggaacttgaggttgagatgacactgcagttgcatttctgtaacagcatccttttctttcatctagccctcacatatttattgagcatctgttccattctaggcaggacttgagagattgaagtaaatagagaacacttgtccttagggatctgttgtaaaatggggagatgaaaatgttggcggggtgctggtagctcatgcctataatctcagcactttgggaggccaaagtgggaggtctgcttgagcccaggagtttgagggcagcctgggcaacatagtgagaccttgtcttacttaaaaaaaaaaaaaaaa

SEQ ID NO: 619 - DNA, 407 bp, Homo sapiens
gaataaaaatgtcttggtcttaaaattttggttttgccaaggcagtcctattttacccactctcttcaaaatgaccttaaaattaacccacttcctgaagaagtggctgctttattattcatttcataaacatggtatttttgattattaacaaagaagttagacgtgctgtgtcacatgtgtatgagttttatggtaaggactttccagttgttgttgtgttatgtatacaaaggaatgcttgtgttgagtggtttttgaaaggtccatggaaacctctcttttctcatttaaagtctgggaaaactctcttttgtatgctgtgagatgctttatacactgtatttaaaagctccactaagagaatttattaaaatattttctggcagtagtccttgaagaagata

SEQ ID NO: 620 - DNA, 2274 bp, Homo sapiens
gaatacttagctttatgtaacagatgcatattcactgaatttttctaaactgaatcatattttaacctcatagaaggatcttaacttacttatgaaaggaacctgatgaagaatcagcttataaaccttcaacttaactttttaaaaatgtgactttccctatgacaaaccaacagtttatcatagttttaaagagtagctattattcacctgactctgaggtagatgctggggttattaaccaaaggaagacagttctcacgtggaaggattcactgataatagattgggaggttattctaaattccacaagctaagagggagtagcaaacagcattgaatagttatgttctagatgggagtattcaaaccaagaagactcaggggagggggtcttccctacgatctagtggaagaagtgcgatcaagccaggctttgaaaggtagagaggatttggacaggatttgggaatagcagctgggtttggtagccacagaattcagtcttgattgagtttcacttttcctgaaaacaaaggacagttcctctgagccaccttaaacctggtttccactaagactctgatacaacattcaggaacacaaagacccgattgcaatcctattaagatttctttcatgcttgtttaattatgacatacagaacagcaataatattaagtcgagtttaattatttttaggtgagcctttatttttcaatatatcttttcctctttaaaaatttcatctctacacaattctacccatcccccaccctttggcatttcctgccaggcctgggaagccaaattctggagggctttgctgcaaaggaaacaaagggtgaactagagaatctcccttagccaatctcccttgctgccctagggaaaatgcagcatggaaacatccttacaaagcaacgggagacgtttttcaaatgcgtttgaatcatctgtgtgagcacggggagaagtgagaaaaggagtgttaacaacgtaggagcaaaagtgtcatttcaaggaactcaactctgaagaacagaaacactaaaccaaaaaaaaaaaaaaaaaaaaacgaagtaaaaattaggccattggtagattttgttctaaagagacagctatgtcagattaaatctaaacgagctgacagagccgttgaggatgggtctctttcctgctagaccatactgtctacctgaggcaccactactactccgaaggagttggagagtgtgtgagcaggtttggtgagtgcttttcgagaagagattgagatgctcaacacaatgagttggtttgtgggtcaggcagccacctgggaatcaatatgctcgccagtaacagattacaagcagagatagcctcagtaatttgcaatggattttagagaaatgagatccgtggtagaggttacaggcttagtgttggcagaatcagttattaatagaatcagactccagggaagtccatctctttacttctgaagaccatctttgcttgatagtgggctggacagcaatgccatttattctaatcagccaattaacacatctttagtgagcacctatggtgtgcaaatcactgcaagatgtgacaagacttttatggcaggacctttggtcaaactagttgaggggtaagctctactctcttgtgaaggaatgcacgggtgtatgtgtgtggtggcgtgtgtctgtgtagatgagctggcggttctctggccggtcagagaaagatcgtcactggtttccacgatcaagcaaggcttcatggagcaagacaacttcacccaggtcttgaagcataacaggattcattctgtgtgataaaggaaaagttgtggagtttgttaatgctcatgtgtcccaggggcagagaaggatgtgttggctcttaatctaactgctgcagcttcgtgtaacctctttgcatataaggaaaccttacatttgaataggacctttgcttttaaaagtgccctgactggctaggtgcagtggctcatgcctgtaaccccagcactttgggaggccgaggcaggtggatcacctgaggtcaggaattcgagaccagcctgaccaatttgatgataccccatctttactaaaaatacaaaaattatccggacacggtggcgggcacctgtaatcccagctactcaggaggctaaggcaggagaatcgcttgaacccaggaggcagaggttgcagtgagccgagatcgtcccactgcactccagcctggggcaatagagctagactctgtctc

SEQ ID NO: 621 - DNA, 2122 bp, Homo sapiens
gtagaacctaccctggacctggaagcatgggtggcatttgcaagagggtaggggtaaagacatggctgctgaaacctagaaattatttccaaatctcatttgtattatttttccaatgcttgaactcccaaccaatgctatctcctacttcttccaaggaaatgataatggctaaaccagagcaaagaaggaagaggagaaagggagggtatttggaaaataaggagacagattcctgcatctacaagatcagatgcctatcggtagaggagggaggtaatgctgtgagccctccttattggactgctaggctctaaaacttaggggcttggtcagggtttgtgggggaagtgacttttggaattgcctctcccagttcccaggttcccattcaggcattgactacaagggataggagaaccactgagaggtagttttgttttttttttctggaagttacaggaaatgaaattcccagatttttagagtctgtgcatttgtatttatgacccccattgttgaaaccattctctccaacaggatcccacaaaacctgtcttgaataatttcatgatttttcctctttaaaaatttcatctctacacaattctacccatcccccaccctttggcatttcctgccaggcctgggaagccaaattctggagggctttgctgcaaaggaaacaaagggtgaactagagaatctcccttagccaatctcccttgctgccctagggaaaatgcagcatggaaacatccttacaaagcaacgggagacgtttttcaaatgcgtttgaatcatctgtgtgagcacggggagaagtgagaaaaggagtgttaacaacgtaggagcaaaagtgtcatttcaaggaactcaactctgaagaacagaaacactaaaccaaaaaaaaaaaaaaaaaaaaacgaagtaaaaattaggccattggtagattttgttctaaagagacagctatgtcagattaaatctaaacgagctgacagagccgttgaggatgggtctctttcctgctagaccatactgtctacctgaggcaccactactactccgaaggagttggagagtgtgtgagcaggtttggtgagtgcttttcgagaagagattgagatgctcaacacaatgagttggtttgtgggtcaggcagccacctgggaatcaatatgctcgccagtaacagattacaagcagagatagcctcagtaatttgcaatggattttagagaaatgagatccgtggtagaggttacaggcttagtgttggcagaatcagttattaatagaatcagactccagggaagtccatctctttacttctgaagaccatctttgcttgatagtgggctggacagcaatgccatttattctaatcagccaattaacacatctttagtgagcacctatggtgtgcaaatcactgcaagatgtgacaagacttttatggcaggacctttggtcaaactagttgaggggtaagctctactctcttgtgaaggaatgcacgggtgtatgtgtgtggtggcgtgtgtctgtgtagatgagctggcggttctctggccggtcagagaaagatcgtcactggtttccacgatcaagcaaggcttcatggagcaagacaacttcacccaggtcttgaagcataacaggattcattctgtgtgataaaggaaaagttgtggagtttgttaatgctcatgtgtcccaggggcagagaaggatgtgttggctcttaatctaactgctgcagcttcgtgtaacctctttgcatataaggaaaccttacatttgaataggacctttgcttttaaaagtgccctgactggctaggtgcagtggctcatgcctgtaaccccagcactttgggaggccgaggcaggtggatcacctgaggtcaggaattcgagaccagcctgaccaatttgatgataccccatctttactaaaaatacaaaaattatccggacacggtggcgggcacctgtaatcccagctactcaggaggctaaggcaggagaatcgcttgaacccaggaggcagaggttgcagtgagccgagatcgtcccactgcactccagcctggggcaatagagctagactctgtctc

SEQ ID NO: 622 - DNA, 910 bp, Homo sapiens
gtagaacctaccctggacctggaagcatgggtggcatttgcaagagggtaggggtaaagacatggctgctgaaacctagaaattatttccaaatctcatttgtattatttttccaatgcttgaactcccaaccaatgctatctcctacttcttccaaggaaatgataatggctaaaccagagcaaagaaggaagaggagaaagggagggtatttggaaaataaggagacagattcctgcatctacaagatcagatgcctatcggtagaggagggaggtaatgctgtgagccctccttattggactgctaggctctaaaacttaggggcttggtcagggtttgtgggggaagtgacttttggaattgcctctcccagttcccaggttcccattcaggcattgactacaagggataggagaaccactgagaggtagttttgttttttttttctggaagttacaggaaatgaaattcccagatttttagagtctgtgcatttgtatttatgacccccattgttgaaaccattctctccaacaggatcccacaaaacctgtcttgaataatttcatgatttttcctctttaaaaatttcatctctacacaattctacccatcccccaccctttggcatttcctgccaggcctgggaagccaaattctggagggctttgctgcaaaggaaacaaagggtgaactagagaatctcccttagccaatctcccttgctgccctagggaaaatgcagcatggaaacatccttacaaagcaacgggagacgtttttcaaatgcgtttgaatcatctgtgtgagcacggggagaagtgagaaaaggagtgtttctgttcttcagagttgagttccttgaaatgacacttttgctcctacgttgttaacactccgtcgcacc

SEQ ID NO: 623 - DNA, 2183 bp, Homo sapiens
atttttcagaataaaatattttaaaagaaaaaaaaagttaggcacatttaacttgtaaaagttagtgtccctcaaattctagaacattcatagacatgaaaatcaccctgcaaaacaaaatccccttcgttcaaagagagctgctcttgcagtctctgctctctcatttctttattcactctataatattcagtgtggggttactgtgctccagcgccaagtccagggggtggagaataacaagggcagagacatagtccttgccctccaagcacctgtgatggtaatacagtgccatgggagcttggtgaagggcctcagccggctgcagagttaggcttatcaaaagtggtgatctctacggtgaatcctggaggacacaatggggtggggaacagaaacagttgttccaggcaaagaagggaggaatctgtgccaaggcccaggggctggtgaacctcaggcgtgtgctgggggtgctgcctcctcccaaatgtcggggcacagggaagtcagtctcgcttatcatggtggccacttggctctacaaacccccattgcccaagtccccacaggcaaaccacacaactgctcttcttctcactcttttttttaagccaagaaagaactcactgaaacagccagtcagtcagggatgagtccaaggctttcctgacagagtgaccatgtttggcttggctgaaaatcacaaagccttggtttcccagttgcgtgattctctttgttctcaaggcttagtgcagcattacagtgggatggctaaacagagaaaaaaaaaaaaaggaggtctatttctttctcttcatacaaataaatatttgcccaagaatggaagtgcttaattcttaagaataaccaaatgctttggacttcttaacaagcaaatcatatacaaagcaattcagtgttcctactaattgagaaattgtttttagcaagaagatgttatgcagcatgtttttaaaaaacaagtttttccaacaacaacaacaacaacaaaaagaaaaaacagaaaataactgaatcactataatatccccaaaggctggctttcacaccatccaagggtcacagctcacgctacattgaagcgtatgaaagagtgtctgcttgtgttacaaacctgatggagcagaggtggggcaggggggaaatgaaagcaaaagggacagacttgaagctgcacttttgcaatcaactaacagttaggaaggacttgacttgctggggctaaggaaaacaaatctggaggttcattttgcctgtgaaattaaaattatactttagtaaataaagctgacgccatttaaccatgaacccggtgacatttcctggcttgctgcagcgtttctgcttgtctccttgttacatttgtttaaaatacaaacacagcatttccatgttgccagagaagcaaatgtgggctgactggctgattttagctgctatggtttttctgtaacctttaacaattgttgtgacaaataagattccatgtaaggtgcaatttctaactgtgcagtgtttgtgaaccacatccaccttctccaggtttggtatttggtcgactaagttgacgatgtcattacctttccttccatttaaaaaaaaaagttaatctgaatcgtgctgagagtttggtatgcacgctatactattcaagggagcattctcttctgtgtcagaataatatatttatgtgtgtgaatcattatacttgaatttgtggcaacattttgtatcaatgaatatatatgacacccaggctgactacaatggcttcaaagagtttaatttctcttaaatggactcagtatccttggaatgtgctgtttaagtgtttctgaattttctacacgccatttttacaggtccatctgtttatgatgtgatgagataaacaatcacgttgattttatgtttcttttcaaagaaaatgaatgtatatagtactaagcagatgaataaattattgaaaaaatatacttcatggatcatgcccactgataaaaatgaatttattttatttgttgaacaaactgactgttcaaattataagaatttatattgtccttattaatatgaatgccatctatttaagtgttgttcaatattgatatgtgttctctaataaaatattttaaacctctttctttaaacac

SEQ ID NO: 624 - DNA, 2130 bp, Homo sapiens
atttttcagaataaaatattttaaaagaaaaaaaaagttaggcacatttaacttgtaaaagttagtgtccctcaaattctagaacattcatagacatgaaaatcaccctgcaaaacaaaatccccttcgttcaaagagagctgctcttgcagtctctgctctctcatttctttattcactctataatattcagtgtggggttactgtgctccagcgccaagtccagggggtggagaataacaagggcagagacatagtccttgccctccaagcacctgtgatggtaatacagtgccatgggagcttggtgaagggcctcagccggctgcagagttaggcttatcaaaagtggtgatctctacggtgaatcctggaggacacaatggggtggggaacagaaacagttgttccaggcaaagaagggaggaatctgtgccaaggcccaggggctggtgaacctcaggcgtgtgctgggggtgctgcctcctcccaaatgtcggggcacagggaagtcagtctcgcttatcatggtggccacttggctctacaaacccccattgcccaagtccccacaggcaaaccacacaactgctcttcttctcactcttttttttaagccaagaaagaactcactgaaacagccagtcagtcagggatgagtccaaggctttcctgacagagtgaccatgtttggcttggctgaaaatcacaaagccttggtttcccagttgcgtgattctctttgttctcaaggcttagtgcagcattacagtgggatggctaaacagagaaaaaaaaaaaaaggaggtctatttctttctcttcatacaaataaatatttgcccaagaatggaagtgcttaattcttaagaataaccaaatgctttggacttcttaacaagcaaatcatatacaaagcaattcagtgttcctactaattgagaaattgtttttagcaagaagatgttatgcagcatgtttttaaaaaacaagtttttccaacaacaacaacaacaacaaaaagaaaaaacagaaaataactgaatcactataatatccccaaaggctggctttcacaccatccaagggtcacagctcacgctacattgaagcgtatgaaagagtgtctgcttgtgttacaaacctgatggagcagaggtggggcaggggggaaatgaaagcaaaagggacagacttgaagctgcacttttgcaatcaactaacagttaggaaggacttgacttgctggggctaaggaaaacaaatctggaggttcattttgcctgtgaaattaaaattatactttagtaaataaagctgacgccatttaaccatgaacccggtgacatttcctggcttgctgcagcgtttctgcttgtctccttgttacatttgtttggctgattttagctgctatggtttttctgtaacctttaacaattgttgtgacaaataagattccatgtaaggtgcaatttctaactgtgcagtgtttgtgaaccacatccaccttctccaggtttggtatttggtcgactaagttgacgatgtcattacctttccttccatttaaaaaaaaaagttaatctgaatcgtgctgagagtttggtatgcacgctatactattcaagggagcattctcttctgtgtcagaataatatatttatgtgtgtgaatcattatacttgaatttgtggcaacattttgtatcaatgaatatatatgacacccaggctgactacaatggcttcaaagagtttaatttctcttaaatggactcagtatccttggaatgtgctgtttaagtgtttctgaattttctacacgccatttttacaggtccatctgtttatgatgtgatgagataaacaatcacgttgattttatgtttcttttcaaagaaaatgaatgtatatagtactaagcagatgaataaattattgaaaaaatatacttcatggatcatgcccactgataaaaatgaatttattttatttgttgaacaaactgactgttcaaattataagaatttatattgtccttattaatatgaatgccatctatttaagtgttgttcaatattgatatgtgttctctaataaaatattttaaacctctttctttaaacac

SEQ ID NO: 625 - DNA, 2128 bp, Homo sapiens
atttttcagaataaaatattttaaaagaaaaaaaaagttaggcacatttaacttgtaaaagttagtgtccctcaaattctagaacattcatagacatgaaaatcaccctgcaaaacaaaatccccttcgttcaaagagagctgctcttgcagtctctgctctctcatttctttattcactctataatattcagtgtggggttactgtgctccagcgccaagtccagggggtggagaataacaagggcagagacatagtccttgccctccaagcacctgtgatggtaatacagtgccatgggagcttggtgaagggcctcagccggctgcagagttaggcttatcaaaagtggtgatctctacggtgaatcctggaggacacaatggggtggggaacagaaacagttgttccaggcaaagaagggaggaatctgtgccaaggcccaggggctggtgaacctcaggcgtgtgctgggggtgctgcctcctcccaaatgtcggggcacagggaagtcagtctcgcttatcatggtggccacttggctctacaaacccccattgcccaagtccccacaggcaaaccacacaactgctcttcttctcactcttttttttaagccaagaaagaactcactgaaacagccagtcagtcagggatgagtccaaggctttcctgacagagtgaccatgtttggcttggctgaaaatcacaaagccttggtttcccagttgcgtgattctctttgttctcaaggcttagtgcagcattacagtgggatggctaaacagagaaaaaaaaaaatgcttaattcttaagaataaccaaatgctttggacttcttaacaagcaaatcatatacaaagcaattcagtgttcctactaattgagaaattgtttttagcaagaagatgttatgcagcatgtttttaaaaaacaagtttttccaacaacaacaacaacaacaaaaagaaaaaacagaaaataactgaatcactataatatccccaaaggctggctttcacaccatccaagggtcacagctcacgctacattgaagcgtatgaaagagtgtctgcttgtgttacaaacctgatggagcagaggtggggcaggggggaaatgaaagcaaaagggacagacttgaagctgcacttttgcaatcaactaacagttaggaaggacttgacttgctggggctaaggaaaacaaatctggaggttcattttgcctgtgaaattaaaattatactttagtaaataaagctgacgccatttaaccatgaacccggtgacatttcctggcttgctgcagcgtttctgcttgtctccttgttacatttgtttaaaatacaaacacagcatttccatgttgccagagaagcaaatgtgggctgactggctgattttagctgctatggtttttctgtaacctttaacaattgttgtgacaaataagattccatgtaaggtgcaatttctaactgtgcagtgtttgtgaaccacatccaccttctccaggtttggtatttggtcgactaagttgacgatgtcattacctttccttccatttaaaaaaaaaagttaatctgaatcgtgctgagagtttggtatgcacgctatactattcaagggagcattctcttctgtgtcagaataatatatttatgtgtgtgaatcattatacttgaatttgtggcaacattttgtatcaatgaatatatatgacacccaggctgactacaatggcttcaaagagtttaatttctcttaaatggactcagtatccttggaatgtgctgtttaagtgtttctgaattttctacacgccatttttacaggtccatctgtttatgatgtgatgagataaacaatcacgttgattttatgtttcttttcaaagaaaatgaatgtatatagtactaagcagatgaataaattattgaaaaaatatacttcatggatcatgcccactgataaaaatgaatttattttatttgttgaacaaactgactgttcaaattataagaatttatattgtccttattaatatgaatgccatctatttaagtgttgttcaatattgatatgtgttctctaataaaatattttaaacctctttctttaaacac

SEQ ID NO: 626 - DNA, 1785 bp, Homo sapiens
gtccagggtgttcccaatatacccacaagacaacatgttcaaaacttcatcacctggtccccacaaacctaccaccctcttccattccctcactctggtaaaagcaagccatcttctccagttacgcaaggcagaagcccaggagtgagcacaatgctgccctttcccttgcttctgacttctcatcaatcctattagaactactgactgcaccccacctctcctccatccccacgatcactgccttcatatgaactgcctttcctgtcctctggactttcagtggcttccttttttgctcacctgtccactttcttccccttccctctctccatccctccacatagtcatcagaaagatcatcaaaacaggcaaatgtgactgtattatttccctcacttatctttgtatgcagtttagagtgatttttaagagcacacactttgaaattaggagaacctgtgtctgaatcctgatttttgccatttgtgtgacttgtcaggttatttaatctctttgagcctgtccctcctcagtgaaataggaataataatacctacctcatagagttgttgtgaggattcagtgagatagactgtttctaaagtgtgtagcacagtgcctggcacatagtgggtgctcacattggagcacactattgtcgctatccctgcaggtgtgagttttacatcctttccaagaggcatttgctaataaccctaactaccgcctatccctgtgacactattttctgcctcagcaccctatttcttttgtagacattttctaagtctgtattttatttatttgttggctttttgtctatttctctactagaatgtaagctccatgagagcaaggatgtgtttgtctgatttcccgttacagccccagcacttagctgagtgactggcacctagtaagcactcagtaactgtttgctgaataaatggaagaatggtcaaaaggctcttcttgatctgatccctgcttgtctgtctggcctcatgctgccactattcctcactgcaccttcagctcaagaaaaacctctttacttgcttctttgaagtgccccttgggcctctgtgtctttgtacctgttgttccctttgcctgaaacaccctttgcctgcccgtctacatggtgaattcctaatcattgatgaagtctcagctcaatggctacctcctctgtgaagctgtccctgatttcttcaggcagatgttctttcccgccttccctgttcccaccgcactttgtaaatacctccatggaagcactttattgtattgtattgtaatttttttttgcatgtctgtttctactattagactgtaagcaccgtaaaagcagagattgtgctttttcatcctcatgttccccgagcctagcccagtgcctggcacgtaatagcttgtcattaaatatttgttgaatgaatctgtgaatgaacaagagtcatgcagttggaaaagtgttagaagctgtatgtattataaaggaaagaaatgcccttggtggcttccagggtgtttttttttttttttttggtctaaagaggagatctagagagtgttatacaatctctttgaatataagattactcgtttggatttttaaaataatatagatcttcataaataattgcaaagatataaacaagctttgtgatttctcaaatgctatgaagtccaaaataaatatttgcactattagtatttccatagtaaatgctatgagaaaatgtacagcaataaattttgaagctttaaaactgtttg

SEQ ID NO: 627 - DNA, 463 bp, Homo sapiens
ctggacactcaagatgtgtcaccacatggcccactgcacttattcaatctcttctcctgggaaccctggaaaatctctctgcttctaggctctgctgggagcaattcccctcctacaatgtcctccttgctcttttatttatccaacccaatcaagagtatctctgcttaaaaaattcttgctgaccacccaagccacaaagagctctcctttccttaaagcatggagtcaacagttatcttacctaccttcacatagttggttcttcctgtttgcacatcctgtttccctagctaaattgtaaacttcttgagttcacatttgtttgccttccccagaaggcagccacagactttccaaagggaaagttctgaacaaagattaattgtttggtcaggagctatcaaccatatcatcactcagtgcaagaccagtctctccagcctcttttgcctccactcca

SEQ ID NO: 628 - DNA, 501 bp, Homo sapiens
tatgaatggccgggcgcggtggctcacacctataatcccagcactttgggaggccaaggcggggggatcacctgaggtcaggaggtcaagaccagcctggccaacatggcaaaaccccgtctctactaaaaatacaaaaagtagccagctgtagtggcgcatgcctgtaatcccggctatgtgggaggctgaagcaggagaatcatttgaacccgggaggcggaggttgcagtgaaccaaaattgcaccactgcactccagcctggatgacagagcaagacgcctctccaaaaaaaaaaaaaaaaagaatatatgaggcctggccactggcacggggcaggttctcattcatggtgcctctacggtgctgatggccacattcatggagctggagcccgtggcagtcgccgtgcggagccctttgcgccaccgccttggtctgcaagtcctcctgacggtcctctgcagtggctgctttaccgctctctccactcctcggat

SEQ ID NO: 629 - DNA, 426 bp, Homo sapiens
agaaaattcaaaatctgaaatgctccaagtttgacactttttgagcactgacatgacattcaaaggaaatgctcatttggagtattttggatcttggatttctggattagatatgctgaactggtaagaatatgtgatacaaatattttaaaacctgaaaaaaatccaaaatccaaaacacttctgatcccaagcgttttggataagagatactcaacctgtatcggtttcatgcaactttttgaaatattagagatttaacaagtcatgactcacttcattgtctgtatatcgtaaatgttaaaggccaggcacggtggctcacgcctgtaatcccagcactttgggaggctgaggcgggtggatcatagggtcaggagtttgagacaagcctgtccaacatggtgaaaccccgtctctgctaaa

SEQ ID NO: 630 - DNA, 375 bp, Homo sapiens
ggccaccttattaggaaaccggtctctggtatttggaacacacacaagcgtggtcccgcctccacttccctaatgccctgtttaaatccctacatgaaagacaacgtgaaaggcagcacgtggtgacgtccatctcgcagcccagggcagtctcgccaggcctgcccagaaggggcctctggaaggcacgaacggaacctgtcctctttacgctgggcccagcacaggacgtgtttggatggatgctgcagtaacagggcctcctccctacccttgagggccaggcacactcaggacctccctccctctgccatccagaaggcaggtccagatctaaaccctactggaaaagaggcagtaaattgtatcaatgag

SEQ ID NO: 631 - DNA, 280 bp, Homo sapiens
cacttgcgaccctcctctcaggctgcttctgacaggcccaagtcacagccaacttcaggggagctgtgttggatccctccaaactccgggaatgatgtgacctccccggcgctcaccctgggcctctaggttagactcagcccagaccctggctcacagggaagcagagcccatggctggcctccacccgctcagacgcccgcacacaggccaggggagggcttgggggcagctctgggagggtccctgtttgcgctgtgggtgtccaaggctgggtgtg

SEQ ID NO: 632 - DNA, 578 bp, Homo sapiens
aagtattaagaattgcatgaggttgacatcagagagttttcacacagtctttggacagagctacacaaaggtactttttaagcctcagtcagtggcatacagaggcccacagctctgcttacacatggtggcatgaacagccccggcttcagatccctgagtagcacaatgcaatcaagagcagctaattctcaccctttggcatctctttttgcttgagtattcagctggtagcagccagcaaggattgtttattaaagattttattttggccctgcagtgttgggttatatgcagactgtcacctgattttggtttatcgttttgtttgccctcatcaggtccttgagtttagagatactttttgagctttaaaataagcaagtccatgagtggtctcaatgaccaggactgtgttttatttcctcctttcctcagagtccctggcttggctcctaggaggtgcatggtacctgttggatgatgatggtgatgacaaagacaatgagggcagataccacggttttcatgcttagtacccaccaggcatggtgctaggtgacacacctgcgtctgct

SEQ ID NO: 633 - DNA, 290 bp, Homo sapiens
aaaagtagaatttactagactctggctcacagaataaggtacattttagggtcagcatctggaaatacccctttctcatatttctctgttacgtgtctatgcctttaaaacagaagttttaaaacttgttgtatggatcatgttggaaataaagactatgaatcaagtgggactttggggagtccaaatgtcagcaaagataattcactagtaatgtcattgtaaaatctcccttaaattaactggaaatgtggcattatttgaagttataaatgaggaatttcacaacg

SEQ ID NO: 634 - DNA, 758 bp, Homo sapiens
gcagcccagaggggccccgagccaggccttaccctgtgttttctctcactctcctgagtgagctgctgggataccggatgtgggacaggcaattggtgtcaggacgtatcccaagcccttgagctgggccagagggtctgtctggtttaggacccctgtgtcagctttgcctgttggctgctttgtgacctctgagacgctttccttcctggtgtgtttggaaatagcactgcttagtctagtctaggctggttcttcctgacccagcagtgccctggggctggaaaagccctacaccctacctgttccctgccccaggcaggacagcactgaagtcacagtgaacaaaaagaacctcctcctctgtaccccagcaccatggctctctgtagagcagctcgagggcatcttggtcaccatccctcattaggtcagttgctaccaaggcactgtgaaagcactgcagagctgcagcccatcagggtcagaaagggacacaggaagactcagttctctggacatgagtcttgtatgtgccacaggcagagggctgggagggggcggggagggcaggatgcctggggatcagagtgcagagcccatgaggagcacaggctgcacaccagcttccaggcccagctctggcacaaatgagtctgtgtaattctgggcaggcgtgacctctgggtcacttttccttagtctaaagtgcgttttgtgatttgcatcaactcattggcgttttggtggcaagaagt

SEQ ID NO: 635 - DNA, 341 bp, Homo sapiens
caatattatactgtcatggagaacagatgagttgttgccagagttaacgaggagtgaaaggtgagcagtaagtggctgaggctatacaagggaagcataaggtatccttgcagtaacagaaatattttgcatcttgactacctatttcagtatcttgattatgatattgtacagtttgtacatccctaatctaaaaatttgaaatccaaaatgctccaacaaatttggagcaacaaatgctccaaaaatattcaaaacgtgttcattgctgacaagatatcacaagtaggaatttctgtacctgacttcatgtgacaggtcacagtcaaaatgcgggtgca

SEQ ID NO: 636 - DNA, 415 bp, Homo sapiens
ttgagttcctcctgggctttctgatcactggataaactgttgtatcattatttctaggtcgttgccccttccatacgagcatgtagactgtatatctcaggcttcctttttatgtcttgggtaatcggttgaataaatacacacataagcccaggcaaaagtagaatttattcacatcattgtattgcaaaggttttaacactgtgttgaattcttgcagtttctgtgtaaactctatggtttggttttaccactttgaatagttaaaaatgtctatttgcttttacttaatttagtgcagttatgtaatgtgtatgcttatgttttctcttgacaaacgcagaaactctgtagtccattgtagaggagctcagtttaaaataaaagctgaaacattctgtgtgataaaaaaaaa

SEQ ID NO: 637 - DNA, 354 bp, Homo sapiens
gggttcaagagattctcctgcctcagtctcctgagtagctgggactacaggcatgcgccaccacccccagccaatttttgtatttttagtagagacgggatttcacctggttggccaggatggtctcgatctcttgacctcgccatctgcctgccttggcctcccaaagtgctgggattacaggtgtgagccacggcgcccagcctaggccttattttcagagtggctttcatggatctagtagtgtaggcattatgaaataatatgatacttaatttcattgccattacagcttgatgtacatcaaacatcaatacataagcagttctctaaatgtattaaagagttgtacca

SEQ ID NO: 638 - DNA, 426 bp, Homo sapiens
ggggaggcctcagaatcatggcagaaggggaaaggcacttatcacatgccagcagcaagagaaaatgaaaaagaagtaaaagtggaaacccctgataaacccatcagatctcgtgagacttattcactatcatgagaatagcacgggaaagactggcccttatgattcaattacttcccaccgggtctgtcccacaacacatgggaattctaggagacacaattcaagttgagatttgggtggagacacagccaaaccatatcagtaatgtattatcattttacatattgctggattcaatttgctcatcctttgttgagaatttttgcttccatgttcataagggaaattggtctttggttttctttgctttagttgtttttatttggttttggaattaggacaatgctgacctcataaaatgag

SEQ ID NO: 639 - DNA, 632 bp, Homo sapiens
caagcgacgctcccgcccgcgcgcccggggcctccaggccgctccccgccccgtgtccccacattgcgaaacggacggtcggatgctccgctccagggccggggtcgcctgtcccctgccgacctggcgcagagccgccttctgcacccggccccgtgccgccctggggttgcttacagccgggctgtgccaccgagctgagcccggaatcgaatggcgggccgcggaaaaggcggccaggcccgcaggggcgactgctcgaggtcccagaacagcgcccggggagccccaggccggcctcgaggggaccgcgggcgggacaggaggggaacagctggcatcggcgcccggcttcagctgcccgactgcggtgggcgggtaggcacgttcccccgcagccacccgcgcacgggtttccaaggcgtcaagggcaattcacctggtcgctgcaagaaagcgactgcgcccccacgtccagccagccgccttgtccatgagaaccacctggagggcagggtccagtgcccgggtgccacccgccacgtggtgacggctctgggatggcacaggctcgtgcgtggccgccgggctgccgtctcggcccctgtgcgggtctgcgctttggcggccgc

SEQ ID NO: 640 - DNA, 276 bp, Homo sapiens
aatcctgacattattcagaatgaaagactcaaactcaaaactcctgtgtgtttgacacaacagctaactgcattacctgaccctggagtggattctgtgctggaaaagaaacattattggggtcaaccaacaaaattggaacatgaatgggagattaaaacatgctaccaatgttaaatctactgaagttgataactgaatggtggttataaagagaataaccttattcttaggaaatgcataaatatttaataagaggctatggtgtatataact

SEQ ID NO: 641 - DNA, 501 bp, Homo sapiens
tcacagaggccaacctgaaggaggaggcttagccatccactgggggagcgttcttctcacccagctgctttgagcctggctgagatggaggctagacttgaggaaggacttcctgacagtgttgggcactggcttcaggtgggtgagagctggagcgatttctgaggctgagtgggcagtgaggtgggggagatgggctatctctgccattgtcctgagaggagaaagcagccatgttgggtgggggtggcgctgacccccaaccccttcccaggtgtcacaagctcccttcgagcgccagggcctcagcagcctggcctggcacagcgggggcaggcaggggcggtgggaggcagctttcaacttcagctctgcctgggaaaaattccctttcatgtggctgcctgtgatctctccaggcggctctgccgaaggggggtgtccagcagggagtagggggaggtgttgcagctggggggcaccctcacccccagcacaagg

SEQ ID NO: 642 - DNA, 319 bp, Homo sapiens
aaaaaggcactgtagaggaatagatggagtttaggctaactgcacgaatattacctcttagaactagtcttctagtaagaagtgaaaatttaaaaatgtgatgtgccattctctgcaataaactcaagttcaatcagtctactacattgccaaataagggcagatttacttgcttaactgttcgccaaaaggcaagggttgcatctgtattgaaaatcaaggaacttgttagccacaggaaggtggcacaaagcactggccaaggtctctgaggaaagcagtcttaactctgctctgatacacaaaggggtgactttgg

SEQ ID NO: 643 - DNA, 423 bp, Homo sapiens
caccccaggccaagctcctactgttaaacaaggtcacaatgaattataccctgattttttagctaaattacaagacggggttgaaaaaatctgtcctcggatgagcatgcctcaagaaattcctcccctcgtatgttagcttttgagaatgcgaaccatgagtgtaaaatggcccatgcgttccgtcccagcaacaaaatgtacctgatcaggaggtgttgcctgcatatattaaagcttgtgaagacattggatcagagacccacaaagccgttctgtgggcatgggccataaaggacagcaatcaaactggctcgactgatcctttctttcaaggtactttggtaggatgattgtggtcatctgagttctctgatttatgtatgctttatctctatctagcagaaattacctcaaaaaaaa

SEQ ID NO: 644 - DNA, 347 bp, Homo sapiens
cataatactctgtaccctttcagtcaatgcagtgccccctacctcaccacaaacatgcacgcaaatctgaatttaattaccagttattagttttatctgatttatatcatataaatatcattatacagtatgtactattagtgtgtaacttttttcattcaaaacaatacttttgagattcatccaagttgcataagtaatttactttaattgctgactggtgttttattttattgattgctgcaatgcattctttcattcttttgttgatggaaatttgtgtttggatattatgccaaatgtttctgtgtaccttcttaaactattatttgtcctcattagtttgg

SEQ ID NO: 645 - DNA, 459 bp, Homo sapiens
tttgaagctgctctcatgaaaaaggaattggtcaaagatgacaggagcacatagaaatctattttcccccttgcacctgtgaatttcagtctgctctttgataatactgcgccattctcctcatgactaaaacgagaatgggctagatcatttttgaggttcctttaagctctaagaaggaacaaacatgtgagagccatcataggtatctgtcaccaaagtgtatgttaaagagaggacggtttctatctccaagttggtgtagagggtataatcagaagacctagggtcaagttccatctctgccataactcttggtgagattttgagtgagtcacctctctcagtgtcagtctactcatctgtaaaaataagaacactggggccaggcacggtggctcatgcctgtaatctcagcactttgggaggccaaggtaggcggatcacctgaggtcagga

SEQ ID NO: 646 - DNA, 268 bp, Homo sapiens
ttaactactagttttgtcattacacttgacacgtctaggtgtcactctttaattttcattctccctgaactttaatttttacaagtctatggtaactttctcttcagtgtttgtaactaccacatttctatagaaatcttagggtgatctattgagattcttcacccttcatttctaattcctcatgatactatgcaagtgacaaaaaggtggcttgtgacagagaaatatgatatttaaataaaatccttagaatcaaaaaagtgcc

SEQ ID NO: 647 - DNA, 935 bp, Homo sapiens
tgaggttgccacacacctgagggactctcgcataaggatggcgcagggctggaagctggactgagacagtgaatgagacagcgctgccggctctctccgcgccgtggactggctcctaggcagtctcacgagcaagtgtgctgttgctcgtgcacgtgtgttttaactgagatgtgagctggcgcgttttctccacccggctccatctgctgggtccctccacattgctgcgcgtgtgcctccagtgccatggggtccccactgtgggcagccctgcattttgcccaactgcctcccaaaccatggaaccccagtgaccttcaacttgccgccatgacgagccactctcattcatatcctcaaacacggtgctctgagcccgaatgagggtttctttagagagatatctggggaccaaactgtagggacagagctcccgtctaaggtgggcctgtggtgaggtctccccagtggtacactttaatcccacagcagggcttgcaggccgccctgctccatccccaccaacactgggcaggatctagcctccaaacctttgccagtctaatagtataaaatgatagctcggtgctattttggttttgcatttccatggtgaacaatgagtttgagagtttttgttcaaaagtcctttgggagttcgagaccagactgggccaccaggagttcaagaccagcccgggcaattcagtgagatgttcatctctacaaaaaataagaaagataaaaaattagccaggcatgtttgtgtgtgcctgtggtcccagctcctcaggaggctgaggtgggaggatggcttgaccccgggaggtggaggctgcagtgagttgtgatcgtgtcagtgcacggctagcctgggcaacagagtgagaccccgtttctaaaataaaaataaaaaacaaaagagaaaagtc

SEQ ID NO: 648 - DNA, 479 bp, Homo sapiens
gaaaatccagactccttacctggataaaaagggcccttggggattagaatcctccttttctcgccaaatattgccaagtgtactgcagccacatgaaagctgtacttcccagacgtgtgatgcttgtgtgtgccaccatgccttctcatggactgttttcttgaaacccagaatgccgcccgcctccaccctatctttgatctaaataaccctgacttcttggaagctcagttcacgtgctatttcccctgaggccttttctgctcagtaatatgatttagatgccttttcccggtgttcctgcatcatcttatttatgctcccattatggctctcaacactttgtatccctgcaactcattactgatttgtgtttccttcaccaaactgcatatacaaaatctcactcaacttgctgttcttggtaattgaatgcagtaggcactcaataaatatgtgctgaatgaacagataattac

SEQ ID NO: 649 - DNA, 450 bp, Homo sapiens
tagaatgaagtttcagactaggagccaaaagagtcatactttccagttttattgctgggccttttaccacacttcattcccttttgtctttcttgcttggaaggtctgttcagggggatgagaactggtaggagatggaggtggaggagggggtagcaatgagtggaacgcattgatgtgagtcctgctcctattgtgtcatcctgagaccttattaaaaagaagcaagaccctagacccataatcaagcacagcatcactaatgatgggtcaaccggatgttgtttctcctgatgtaaggcaatagagtttatacggcatacctagctagtatgtattctggctgaaaatacccaacaggagccaccaccaatgatttatatttaatctaacctacacataagaaataaagaagataaataaactaaatgaaatcactggaaaggaact

SEQ ID NO: 650 - DNA, 1190 bp, Homo sapiens
tgaagaggaagagtttctgtgccatgatttaggagaggtttgaattacagagagctgagcctagcattgggggatgcttttgccctggagcagtttgccaattagagcaagcagttgagaggctaagatgtattaatacttccaaatcagtgcaggacaagaaggccaaagaatccaggacctgctgagcttgggagtgctgctaaaaacacctcttgccttgggcaagggataactagaaggctatattttaaggagtaaggtgaacctgaaataaattactcttcacatggactgtatatgctttttggtcatctaggcaggccagaaaatcttgaactttgaaattggattaggatgattttagatttgttagttctagatgttttatagaagcaaacaaaaatttctagaggaaaataactgcatcctgtgctcccaattatttaacactttttcaaatacagtgtcccatggtgcatatgcacacacacatgcacagtcacaaataaccaggtgtaagaaaggacaagataatatgaacaagagctagcaaaaacaaaatcacagaaacacccactgggactccagatactggtgatatcagatattgactttaaaaagttatgcttagctgggtgtggtggttcacacctataatctcagcactttgggaggctgaggcaggaggattgcttgagcctgcaagttcgagatcagcctgggaaacacagtgagacccccatctctatacaagttacctgtgcatgtgtggtgcatgcctgtggtgccacctactcaggaggctgaagtgggaagattgcttgagcacaggaggtcaggactgcagtgagccatgatcgtgccattgcccttcagcctgggtgacgtgagaccagtttcaaaaaaaaaaaaatgaaaaattatgcttactatgttgatgaaaatgaaagcaaagtttgaaaattttactagaaaactgaaactgtaaaatatgaaataccttttaacaagaacaaaacagaaattgtagaatcaagaaatataataaccaatgttgaataaaattcagtacactggtttaacagcagattaagtacaacttaagtgaatttgtaaactaaaagctaaagatagcaagaacttagcaaaaataaaacaaagagacaagttatggaaaatacagaaga

SEQ ID NO: 651 - DNA, 314 bp, Homo sapiens
gtctcatcttccatcttctaaagcaaaacaacaacaacaacaacacacagttgtgctagttttttggcttacctccttacaaggtcatactgctaaaaccctcactctggcatgactaatctgacacatagtttgcctttgttctccagaggtctaatgaacagctccctgtacaccaccaggtacagtctacactctttgagctggccttgagccccttgccatctgagctgcctcccttgttcctattttagcttcctgcatgcccaggcagcaagtgacttggctccacaaacagcctgttgctatgatct

SEQ ID NO: 652 - DNA, 349 bp, Homo sapiens
attttcaacacttgagtaatataaaggtatctcaatctatatattaatatatactcttttaataaagaattgcccttgggctccagtgtttgtttgctcattcttatatttggcaaacatgtgtggatacatctattatgtgttaagtgcagtacaagggactgggcacatgaggatgtgcaagacagagttccccatttttaaggagttgatgttctcataaaggagaaaaaattaaaatggcacatgcagaaaaatagaaaaagtgctactgtagatatgagcacttaggagaatacctaagccagattgcagattttgtattttaatgttgttttttctttttcca

SEQ ID NO: 653 - DNA, 385 bp, Homo sapiens
aaaactgtagaactaattatgaataacaaaatatacatatgaaagccattaatttcttacaaattcactatgaccacatcaatttaagtactgcatgtgaaagccacaatacaagcgactaacatatcaaataggagaatggtccaaccagaatggcttcactggccactggcagctctttcaacagatcagtattagttcatttatttgtattcacctttaataatgatatgctatgaaaaaccttagcataccatcagtcattctaaagggaagactgcttttgcatggtgtctggctgtgtaaactactgataaaagaacacagtattcagccatgcttttcagaccagcaaaacaatttaatagaattgaaatatggtgag

SEQ ID NO: 654 - DNA, 201 bp, Homo sapiens
actggaggaaaggaatatatttcaaaaatgttactgaatccagaataaaaattgagttgtctgtaatgagagttaaaaattcatgtgactaccttattatacagtattttattatataaacgtggcattttacagtataatacgctattttattgtataaagtgctgttagtatattttcttatctctgtttatagttaaa

SEQ ID NO: 655 - DNA, 485 bp, Homo sapiens
ctaaccttcctcggctcttcggcagcgaaatcgcagcagaggagatggagcagcttcgtgcgcattgcctcatttgcgcccaacgtgaaaagaactgccaggatgccccaggacaccagctcccctggcttctgcggtgcttgcacagtcctgaatcagcccgagagctgtggatctgcgtcccctggctgcatagccgactgccggctccatggaggggcctgtgccggagaacgcacatgttgacttatttcttcagtctaggcctttcttggcccccttggttattcattctagatgatacaactcttatttcagttcaaatgtctcacggaagaggcattgaagacagagtggatgcccgtgtttgttggcagtaggtagtatttaccactccggctgtagtaaaagaacaaaaggagaaattacacctatttctcatatttaagggaaaagcaattaaatcaccaaagtcaaaaaaaaaa

SEQ ID NO: 656 - DNA, 1486 bp, Homo sapiens
tgtatactctcagttctcattcagtataaataaaattttaaaatcctttcatagttctattagaaataagtagtaaattttgatatattgtacatacacacgtgtgtgtgtgtgtgtgtgtgtgtgtgtgtgtgtgtgtgtgtatttgtgtgcctctggtcaactctaaggatgacagacactgtgtaacaacacctgggtcaactcttttaatttatatacaaagcaaagaacaacattaatggagatgcacaatgattattcaaacaagctatatatatgtacaaaggcaaacagacacataacagtctctgcagactgattgtatatagtaagaaaagatcaaaagactttaaaacctaaatgacttttgacatacaaactcttcttgagaatgtttgttgtaaatggtttcaaaaatacaaattatagccaatcaaaacattgctttggttggtgcatttaagtatccaactcaaaaagcatatcaaatattttgggtactaggcagtttccaaagtagcatggtagtattacttgttaaaagggttctgttttcattaacagtactaagtggaagggatctgcagattccaaactggaataagctctatcatattctgaaacaagaattagaatgacttgagaacgggcaaataacaaagcaaaccaatataattatatggtcattctgaccccagctcttatacaaattatacatgtatttttgtgtatgtttgtgagagttgtatgtatgtgaatgtgtgtgagtgtgtattcacatacacatatatactggaacctatagtagaaaaggaaactagtagggccaaaaaaaaaaagaaaaagaaaaagaaaaaagaaaaaaaaagaaaaaactgggacctaagtataaatatctcatcctaaagtaaacaataagtttatagttaacgaagatttttttctatttaaaaccccattttcctaaagaacaaagtagtaaaataacaaaaaaatttaaaaaaattaaaaaataaaaaaaagaggtcactaaaagaccaagatgggaaacgtaacatggaatacaagcttgaatctgggaaacaagctcaaaaaacagtgaaaaaaaaaagtactggtttaggagtccaaaattccagtgaaacaaactttttgccaatagaccctaggggtctaagaaatagaattagggaagagtttaacacttacttacctatattctcagacagatttttctggaagaaaacccctttttttttttttttttaaacagtaacatccagagtgacaaattgcaggagatttaatgtataaaatttctaggaattaaaagcttaaacccaaaaattgttcatccatatataagaaattatcgaattaaaacttaatgtatgtcaattattttcaaatgtctaaattcctttggaaataaaaatatcagttttactttgaaattgctcaacttctgctattcatatggtct

SEQ ID NO: 657 - DNA, 1225 bp, Homo sapiens
cttctggcactagaggaccccaagcagttaatacagacacataacagtctctgcagactgattgtatatagtaagaaaagatcaaaagactttaaaacctaaatgacttttgacatacaaactcttcttgagaatgtttgttgtaaatggtttcaaaaatacaaattatagccaatcaaaacattgctttggttggtgcatttaagtatccaactcaaaaagcatatcaaatattttgggtactaggcagtttccaaagtagcatggtagtattacttgttaaaagggttctgttttcattaacagtactaagtggaagggatctgcagattccaaactggaataagctctatcatattctgaaacaagaattagaatgacttgagaacgggcaaataacaaagcaaaccaatataattatatggtcattctgaccccagctcttatacaaattatacatgtatttttgtgtatgtttgtgagagttgtatgtatgtgaatgtgtgtgagtgtgtattcacatacacatatatactggaacctatagtagaaaaggaaactagtagggccaaaaaaaaaaagaaaaagaaaaagaaaaaagaaaaaaaaagaaaaaactgggacctaagtataaatatctcatcctaaagtaaacaataagtttatagttaacgaagatttttttctatttaaaaccccattttcctaaagaacaaagtagtaaaataacaaaaaaatttaaaaaaattaaaaaataaaaaaaagaggtcactaaaagaccaagatgggaaacgtaacatggaatacaagcttgaatctgggaaacaagctcaaaaaacagtgaaaaaaaaaagtactggtttaggagtccaaaattccagtgaaacaaactttttgccaatagaccctaggggtctaagaaatagaattagggaagagtttaacacttacttacctatattctcagacagatttttctggaagaaaacccctttttttttttttttttaaacagtaacatccagagtgacaaattgcaggagatttaatgtataaaatttctaggaattaaaagcttaaacccaaaaattgttcatccatatataagaaattatcgaattaaaacttaatgtatgtcaattattttcaaatgtctaaattcctttggaaataaaaatatcagttttactttgaaattgctcaacttctgctattcatatggtct

SEQ ID NO: 658 - DNA, 426 bp, Homo sapiens
gaaaccagcagagtgaaaaggcaacctatggaatgggacaaaatatttgcagaccgtatatccaataagggaataatctccaaagtatttaaggaatttctataactcagcagtaaaaaacaaaagacacacaaaaaaacctaataagttgatttttaaatgagctaagtacttaaataggtatttttccaaggcaatgggtatgtgaagaaatgcccaatgctcgatgtcactaaacattagggaaacataaatactaaaactacaatgatgtatcacctcacacgtgtcagagggattattatcaaaacaaaaaagacaacacgtgttgaagaggatgtggaaaaattggaaaccttgaacatttttggtgggattgcaaaacggtgcatctgccatggaacacagtatagagtttcctcaaaa

SEQ ID NO: 659 - DNA, 506 bp, Homo sapiens
tcccaaacaatactgcccctgatggaagtataacaaggcattgcaaggtctaactgctctgtccaatgagttaaccaaaaactcagcggtaagtgacccctttaaaaggtgcctagaaaaatcattcagtaaatggaaaaaaaaaatcatagcctcagttcttacttctctcacagccatagtaggcgtattcattcttgttgggtgttttgtcataccatgcatccgtgggctggttcacagactcatacaggcagcacttactaaaacctcccttaattctcctccaccttattcagagaagctttttcttttagagaatcatgcagaacaactaagccaagacattttaaggaagtttgaagagaaggaactgtaaaaattcaagatgaagaactgttaaatatagtgaaccccaagtttctattcaaagaatcagtatgtcagtatgttcagctctcttattgattctccattttaaagtttaacttcctggttccctttgc

SEQ ID NO: 660 - DNA, 342 bp, Homo sapiens
accattgcaccgggagctgaaaatatacagagaaagctgagaatgcaagagtcgctggcttccatgcccatcggcagtgccctatcactccctttatcctgaatgttaatgtgtattggaattctgtcacttgcaactgaatgagcccagttcaatataaaaattaatcaggaaaagagcaggcctatgagaaggcttcaggcaaaggaagacatggaatatgtatgaatggtggcaagcggcaggaggagcatttccttttgttggagtcctgggtggtctccctagctccctaacacatgctaaacccaaacacatttgcagtcttagcctggtatgcag

SEQ ID NO: 661 - DNA, 391 bp, Homo sapiens
tgtgacatcagactattcctaggaaacttgtctgaacttgtagcatctgagtaaattttgcagcttcgccactggataagaggtgaacactgaaggaagatcacagaattgtaaaaagttgaaagatttcttagaatcaagtagtctaacattctagcccatgcagaaatccttcctacaccatccttgatgaatgttcattcagcttttatgtgaacatttccagacattggccactagcggcttctcaagggagtttgttacatggttggaagtctctaaatgttacttgtgcttacagaactcaatttggcctttctgtagtaaccacctagtgaactgagatctgccttccttagcaacacagaccttcccactgaacagcccttca

SEQ ID NO: 662 - DNA, 420 bp, Homo sapiens
gccccttgtaaccatcaatttatagccagttatacacccctacccatttttcccttcctatattatttgaaaacatatcttagatataatttcttccacaaatatttcagcacattctaattccttataattttgtacatctttcaagccatagtgcatgtttttttgaagtggttttccaattattttttcattggctctgctacattcaagaatatttcgtatggtaagccacagtacaaattactagaagggaagttgacactcagtgactatcaggagtatacttagaagaagaaaaacatggaagtttagtgttgcctattacctaatataagaaagaatcggagctttattttcttttgttcttctttaatgtgcaaaacggagtatacaatatggtggcctgtaggcatgcca

SEQ ID NO: 663 - DNA, 445 bp, Homo sapiens
gtttgactagaactgagccacatgatcatggtggaagctggaaaacgtcatctgcagcaggctagctgtgtgttcagctaaaatccatgcatcccattgttaaagcaaggaggagagaaaggattccagtagacacggagcaggctttgacgcccagaccgccagaaacctgggcgtttcctggggtttgccaggtctagtgaactcttcatttataccaggccctgtgaactcacaggggtaggcagaacagaccatccctctttcatggcgcccttgtctaatggggagaaaggctgaaataattcagtgcaagaaaggaagagtaaggggtgggaagagagcgtgttaacgagtctcttacatgattttattttccaagattaggttatagacactaaaatcataaaatgttgatttgaaaatgtttttacaggcacaggat

SEQ ID NO: 664 - DNA, 496 bp, Homo sapiens
ttgttctcaggacccacccgagggtgggtcaccatggctttggagcacctggtagtgtggcgtgtccacagtgaagaccagagtttcattgtccttaagactgacctgggagacgtggctgcaggccattgaggaaggtgaggcaaaagcttcctgtctgctccccgtgtgctgaggagggagctctgccatgtgctttactttcacacgttatattctacgagtcttgttttacaaaagcatcccttccttgaggcttcggctgctcatcgctgctcatcatcatagcgtgccataacatatagtaagatttgggtttgtttctgggagagatcttggcatagagaaaggagaaatgcttagagccaccatcaagacagttgggatgaaagctggggataggcagaggctggaggaaacatgtgcaccccttgtaaacacttattcatgttttagttattcacttaaagtgttaaattagtaaaaatagtattga

SEQ ID NO: 665 - DNA, 411 bp, Homo sapiens
  misc_feature (102)..(102): n is a, c, g, or t
gcctaaggagaatgcaaaacgcattgcaataaacaaaatccacttcagcatcattcagttcaatttaaaatgatagtggcattcaggctgcgtacagagatntacactttaacaccattcatgatttggcctccagactacaacaacattcaatttagttactcttttgaattgtgtgctaggagcatggactttggaatcagacagatttgaatttgctttcaggctctaaatcctgtttttttcccactgtggaaggcagaataatgttcccccaaagatgtgtattccctaatccccattcaactgtggaatatgttcatttacatgggcaaaaaggactttgcagattttgattcaggtacagactctaggagaggagagtatcttgcattatccaagtgggcgcag

SEQ ID NO: 666 - DNA, 810 bp, Homo sapiens
tcacaggcagtatcagactcacagtagtaccaactcaaaacagaccttcccctccgcagcattccgcatgccccacattatgctagaacctctatttgaatttttcttctagagcaaattcctagcctctcctctaggaaggggagggctggggaaagagcccttggggtcttttcaaggggttcactgaccctacaagctctaagctctctctacagctgtgctgtccaatatggaaatcatgagccactgagtggctactgggcacttgaaatatggctagtgcaactgagaaactgaattttttatttaatttaatgaacttaaacagccacatatggctaatgactacaatactagaaacaagatataaaacatttccatcatcacagaaagcactactctacagagtaaagacttattataattggatatatacattcctgaaaaatgtggtatataaaatattataacttgagggctcataaggcagaacactcaaactctatacagtattataaccaaatccctaaaaagtaagaatcccaacttttaaaactagcgtgatttttaaaagacatttaattcttaataaagaaatattatgataaataagtatacatttaattatttatttatggataaatgaatgaatgaaatgaatgacagggtctcacaatgttgccgaggctggcatgccgtggcgcaataatagctcactgcagcctcaacctcctgggctcaggcaatcctcccgcctcagcctcccagtagctgggattatagacacatcccaccacacctggctaa

SEQ ID NO: 667 - DNA, 196 bp, Homo sapiens
ggagtttttggaagaggttgcttattaaagcaaatgaaatccctactgtgtggtatatccagcattgtaacaaaacaaaaggaacaacttcagacagaatttaggaggaaatattaggtcaacccaacttatccaagccacccccacatcagctccctattggcaactgcttttcctggactccgcattcctgtgt

SEQ ID NO: 668 - DNA, 474 bp, Homo sapiens
aaagagagtctgtctgtactcactcttcaatccagttcctccaattctccctggaatctgctccactctggcttttgtctctaccatttcactgaaaccactcgccaagatcactaacatcctcctcactgctaaatcttctgatcaattttcagctggcatcttacctgacccatcagcagcatctgacaaggtgggttactactgcttcccttggtgtctagagtatcacgatttacaccttcctgtctgttcctcaatctgccctgctgactccatgggaccaggagaggccccagaccactcttctcactcccttggtggcctcaatccttcttatgactttgaacaacagttcaatgctaatgacttcaaatttgcctttttaatcctgacctcccactgaagtccagactctgcctacatgacctttctgcttagatatctaaagaggaatctcaaatgtaatgtgtt

SEQ ID NO: 669 - DNA, 511 bp, Homo sapiens
tgggacaggggctagaaggaagagaggctcggaagtgtgttgtgtaaacgtggttctgttttgtctaatcttttactacctgtagggacaggtggatgcagtggagctgctggcaggaaaggtggagttttttcaaggtcacgagttaagcaatagagtagaatatctttgcagctgcaagaggaggtgcgagcagcttgttcacaaggtatattttgcaggagtttccccttacaagatcttatttgcttgagagtagcgttaaggatttctgtgccaacagttagctggatctctggggttgaatcgttatcaccaatctatagttaaaataagcattaaaaaaaaaaagaagtctactttcaaagttttcccgaagtgccagtctgaagcagctacctttaaaagctgttcttgaataataggttgctatatcctagtctgtaatcttggactaatgtctgaggaaggaaaaaaaaaaaaagaatattctctctttgtccgattaaga

SEQ ID NO: 670 - DNA, 375 bp, Homo sapiens
aacttcaacctcgtttaagtgtaacagcaaataaacgttgtgtagagatctcaagatttgaaagctccactcccttactacacacactagtgctcatgtatatacatttgaacatatgaaagagtaagcaaaccagtgaagacagagttttgtacttaaaaacactaaaaatagtttaatctttcttgtctatattttcacaatcaagtttgtatgttacaaagttctaaaaatctcagtttggtctgaatatttatatttaaaaaccaaacctaatctgatggaaaagcagatgacgtctcatttatgctttaagtaacacactgaaaatgcatatcacgccagtgtgtgtgggtaggttttgcctgttcaaac

SEQ ID NO: 671 - DNA, 1686 bp, Homo sapiens
agctcctccccctgcgtctctggcctcgccggtcttggggggatggttccatcatggcgtcaatgcagaccacaggaaggagggtggaagtatggtttccaaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgtttta

SEQ ID NO: 672 - DNA, 3985 bp, Homo sapiens
agctcctccccctgcgtctctggcctcgccggtcttggggggatggttccatcatggcgtcaatgcagaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattgttgaaaggtccagttctcagtaccatgtgagttaatgatactacaactaagttctttttaaaaagtgattaatgtattttataaattaccttttcacatatgcaaaatctgtttctactacaatgttatttttactaatgccttattgttgcactctttttgaaatatcctgcagtgaatatatgaatcaatttgggcttaaaactgaaagccagttggctgaaaggtttgaaatacgtaccccagtaaaaccattcaatcaataattggtaaataatattttaaaattgtttttaatctgtatagatgacattttgtagctttgtacatgttgttaattaagggcatataattttacactcaaagtataattgctgaactcaggggtgggtagacttcaaaaatatgtctgctatagaaataacttgaaaaaaaaaattaaaaccgtggccagccaccaaattgtggacactgtttatatactgctagttaacaattaccacttttaaaaaattataaccgtttttgttctatcttgactagataaattctcacaatgatctctgtcagttttattagttggcctgtttaaccaagacagaaagtctttgaattactcatagttttaaactgcttttaatatgaaaattgcagctgtaaattatgtattttcatattttgcgtaactgctctacactactgtttgacttgatcttcttctgggggttagggagaaatctgtctccatattgctggttctcttaccaaaatgcttttataaagaaatgaccggtgacatttattcaccaaaggaattaatatactgagtcaaagattaacaatgctatactatagagtaataggtcatatatagcctcaattgagttttttatgacaatattttaacatacctctctctctacatataaataccataaagtaaactaaaatgacacagaggaaagtagaggaaaatgaaataatttcggtacatcttatggtttaaagagtagaaaataagatgaaatatcctaaaatataggagcacagacatttaaaattcataatcaggctaacaacactctcttgaatttaggaatcattgaaaactccttgcacttagatttaatttatatgttagttacattattaaaagtcataaggcatttatctgagtcattgctctacagagagcaattaatggcttgtaataataaaaagaatatttctctgtaatgcattgttgaaagacaaccagaatatcaagaaaatgtatataggaatatgctacttgcctcctccctgcatttcctcgtggggcactatttgcgacataggcctacagaattagactttcatacttagaagataaggtacactcttcttcttttatttatttatttatttatttttaggccattcttctggtttgccaaattctattaagacagtgatacatttgcttccttatttatgcatgcttagatcatgaacatgatgcccttcttttttttttttttctttggtcaagtagggattaatgccataggtttagagagaaggattgttttcagtttttaagagaattttttaaaaatacattttatggttctcttaaggaattaatattcacttctgaaggacttacttgtaatatataatttatcattttagccagcagggaaataaatcatttttaatccccagaagaaagtgctggaaatagcttctatatagtcagcagttcacctggagaaagatcttaattccttgttgttttgactaggaatatcaatatttggtataaaataactagaatagtttattaccttttccctcatgaaattttaaatatatgcaaatatatatatcattagattcctgtggtggataataatttcttcagattctaaaacaggtgtctagtgactgcttaattgtttccaagttgcatcaaagatgaattggtaaataatggaaatgagtagtgatatgaaaatggttatgtaactacatattacttgtttctggtaatcaagtcttattttttaaaagcctattgtttttcagaattgagatatttaaaacttgttataacttcttcctaaaaatagaagagaagaggaggtactgtgtgttacaaaaatttttttaaataaaga

SEQ ID NO: 673 - DNA, 3554 bp, Homo sapiens
  misc_feature (3339)..(3339): n is a, c, g, or t
  misc_feature (3353)..(3354): n is a, c, g, or t
  misc_feature (3361)..(3361): n is a, c, g, or t
  misc_feature (3363)..(3363): n is a, c, g, or t
  misc_feature (3367)..(3367): n is a, c, g, or t
agctcctccccctgcgtctctggcctcgccggtcttggggggatggttccatcatggcgtcaatgcagaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattgttgaaaggtccagttctcagtaccatgtgagttaatgatactacaactaagttctttttaaaaagtgattaatgtattttataaattaccttttcacatatgcaaaatctgtttctactacaatgttatttttactaatgccttattgttgcactctttttgaaatatcctgcagtgaatatatgaatcaatttgggcttaaaactgaaagccagttggctgaaaggtttgaaatacgtaccccagtaaaaccattcaatcaataattggtaaataatattttaaaattgtttttaatctgtatagatgacattttgtagctttgtacatgttgttaattaagggcatataattttacactcaaagtataattgctgaactcaggggtgggtagacttcaaaaatatgtctgctatagaaataacttgaaaaaaaaaattaaaaccgtggccagccaccaaattgtggacactgtttatatactgctagttaacaattaccacttttaaaaaattataaccgtttttgttctatcttgactagataaattctcacaatgatctctgtcagttttattagttggcctgtttaaccaagacagaaagtctttgaattactcatagttttaaactgcttttaatatgaaaattgcagctgtaaattatgtattttcatattttgcgtaactgctctacactactgtttgacttgatcttcttctgggggttagggagaaatctgtctccatattgctggttctcttaccaaaatgcttttataaagaaatgaccggtgacatttattcaccaaaggaattaatatactgagtcaaagattaacaatgctatactatagagtaataggtcatatatagcctcaattgagttttttatgacaatattttaacatacctctctctctacatataaataccataaagtaaactaaaatgacacagaggaaagtagaggaaaatgaaataatttcggtacatcttatggtttaaagagtagaaaataagatgaaatatcctaaaatataggagcacagacatttaaaattcataatcaggctaacaacactctcttgaatttaggaatcattgaaaactccttgcacttagatttaatttatatgttagttacattattaaaagtcataaggcatttatctgagtcattgctctacagagagcaattaatggcttgtaataataaaaagaatatttctctgtaatgcattgttgaaagacaaccagaatatcaagaaaatgtatataggaatatgctacttgcctcctccctgcatttcctcgtggggcactatttgcgacataggcctacagaattagactttcatacttagaagataaggtacactcttcttcttttatttatttatttatttatttttaggccattcttctggtttgccaaattctattaagacagtgatacatttgcttccttatttatgcatgcttagatcatgaacatgatgcccttcttataataanaacaatgggccaannagggctnangccnaaaggttaagcacaacacaggatggtccacaagattttataggacgacattatataacaaaatgcatttatatgaggtcctcgttagcggaactaaatatttacctcttgataggactacactggaaaatatataatgatagtgttagtcacgagagaaaatactacattcaagtccctagatgagt

SEQ ID NO: 674 - DNA, 3836 bp, Homo sapiens
ggggatcatggcgtcaatgcagaaacgactacagaaagaactgttggctttgcaaaatgacccacctcctggaatgaccttaaatgagaagagtgttcaaaattcaattacacagtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattgttgaaaggtccagttctcagtaccatgtgagttaatgatactacaactaagttctttttaaaaagtgattaatgtattttataaattaccttttcacatatgcaaaatctgtttctactacaatgttatttttactaatgccttattgttgcactctttttgaaatatcctgcagtgaatatatgaatcaatttgggcttaaaactgaaagccagttggctgaaaggtttgaaatacgtaccccagtaaaaccattcaatcaataattggtaaataatattttaaaattgtttttaatctgtatagatgacattttgtagctttgtacatgttgttaattaagggcatataattttacactcaaagtataattgctgaactcaggggtgggtagacttcaaaaatatgtctgctatagaaataacttgaaaaaaaaaattaaaaccgtggccagccaccaaattgtggacactgtttatatactgctagttaacaattaccacttttaaaaaattataaccgtttttgttctatcttgactagataaattctcacaatgatctctgtcagttttattagttggcctgtttaaccaagacagaaagtctttgaattactcatagttttaaactgcttttaatatgaaaattgcagctgtaaattatgtattttcatattttgcgtaactgctctacactactgtttgacttgatcttcttctgggggttagggagaaatctgtctccatattgctggttctcttaccaaaatgcttttataaagaaatgaccggtgacatttattcaccaaaggaattaatatactgagtcaaagattaacaatgctatactatagagtaataggtcatatatagcctcaattgagttttttatgacaatattttaacatacctctctctctacatataaataccataaagtaaactaaaatgacacagaggaaagtagaggaaaatgaaataatttcggtacatcttatggtttaaagagtagaaaataagatgaaatatcctaaaatataggagcacagacatttaaaattcataatcaggctaacaacactctcttgaatttaggaatcattgaaaactccttgcacttagatttaatttatatgttagttacattattaaaagtcataaggcatttatctgagtcattgctctacagagagcaattaatggcttgtaataataaaaagaatatttctctgtaatgcattgttgaaagacaaccagaatatcaagaaaatgtatataggaatatgctacttgcctcctccctgcatttcctcgtggggcactatttgcgacataggcctacagaattagactttcatacttagaagataaggtacactcttcttcttttatttatttatttatttatttttaggccattcttctggtttgccaaattctattaagacagtgatacatttgcttccttatttatgcatgcttagatcatgaacatgatgcccttcttttttttttttttctttggtcaagtagggattaatgccataggtttagagagaaggattgttttcagtttttaagagaattttttaaaaatacattttatggttctcttaaggaattaatattcacttctgaaggacttacttgtaatatataatttatcattttagccagcagggaaataaatcatttttaatccccagaagaaagtgctggaaatagcttctatatagtcagcagttcacctggagaaagatcttaattccttgttgttttgactaggaatatcaatatttggtataaaataactagaatagtttattaccttttccctcatgaaattttaaatatatgcaaatatatatatcattagattcctgtggtggataataatttcttcagattctaaaacaggtgtctagtgactgcttaattgtttccaagttgcatcaaagatgaattggtaaataatggaaatgagtagtgatatgaaaatggttatgtaactacatattacttgtttctggtaatcaagtcttattttttaaaagcctattgtttttcagaattgagatatttaaaacttgttataacttcttcctaaaaatagaagagaagaggaggtactgtgtgttacaaaaatttttttaaataaaga

SEQ ID NO: 675 - DNA, 3900 bp, Homo sapiens
atgtgctttaatatgtagcaaatgtatcatttcgtattttaaaatatgctaggtaagcatttcctcctgtccttaaaaagctcttttaaacaactttaaaatattgtatagatagatgtacacaattttctgaataattggagttatatttacatcttttcactctttaggaaaggactggcctgtttctgtgttgggttccttcctgagtgtggcttccagctcagtggctcagacttcaagatgaagacttcagtcctggttgtgtatggtcttgggccagttaccatatgtcaggggagaagatcttctcccctgataattgaaattatttctacattaaacagacttgtagaatttacttatacatgcttgactttttaattatcttttttctccttttcttaaagatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattgttgaaaggtccagttctcagtaccatgtgagttaatgatactacaactaagttctttttaaaaagtgattaatgtattttataaattaccttttcacatatgcaaaatctgtttctactacaatgttatttttactaatgccttattgttgcactctttttgaaatatcctgcagtgaatatatgaatcaatttgggcttaaaactgaaagccagttggctgaaaggtttgaaatacgtaccccagtaaaaccattcaatcaataattggtaaataatattttaaaattgtttttaatctgtatagatgacattttgtagctttgtacatgttgttaattaagggcatataattttacactcaaagtataattgctgaactcaggggtgggtagacttcaaaaatatgtctgctatagaaataacttgaaaaaaaaaattaaaaccgtggccagccaccaaattgtggacactgtttatatactgctagttaacaattaccacttttaaaaaattataaccgtttttgttctatcttgactagataaattctcacaatgatctctgtcagttttattagttggcctgtttaaccaagacagaaagtctttgaattactcatagttttaaactgcttttaatatgaaaattgcagctgtaaattatgtattttcatattttgcgtaactgctctacactactgtttgacttgatcttcttctgggggttagggagaaatctgtctccatattgctggttctcttaccaaaatgcttttataaagaaatgaccggtgacatttattcaccaaaggaattaatatactgagtcaaagattaacaatgctatactatagagtaataggtcatatatagcctcaattgagttttttatgacaatattttaacatacctctctctctacatataaataccataaagtaaactaaaatgacacagaggaaagtagaggaaaatgaaataatttcggtacatcttatggtttaaagagtagaaaataagatgaaatatcctaaaatataggagcacagacatttaaaattcataatcaggctaacaacactctcttgaatttaggaatcattgaaaactccttgcacttagatttaatttatatgttagttacattattaaaagtcataaggcatttatctgagtcattgctctacagagagcaattaatggcttgtaataataaaaagaatatttctctgtaatgcattgttgaaagacaaccagaatatcaagaaaatgtatataggaatatgctacttgcctcctccctgcatttcctcgtggggcactatttgcgacataggcctacagaattagactttcatacttagaagataaggtacactcttcttcttttatttatttatttatttatttttaggccattcttctggtttgccaaattctattaagacagtgatacatttgcttccttatttatgcatgcttagatcatgaacatgatgcccttcttttttttttttttctttggtcaagtagggattaatgccataggtttagagagaaggattgttttcagtttttaagagaattttttaaaaatacattttatggttctcttaaggaattaatattcacttctgaaggacttacttgtaatatataatttatcattttagccagcagggaaataaatcatttttaatccccagaagaaagtgctggaaatagcttctatatagtcagcagttcacctggagaaagatcttaattccttgttgttttgactaggaatatcaatatttggtataaaataactagaatagtttattaccttttccctcatgaaattttaaatatatgcaaatatatatatcattagattcctgtggtggataataatttcttcagattctaaaacaggtgtctagtgactgcttaattgtttccaagttgcatcaaagatgaattggtaaataatggaaatgagtagtgatatgaaaatggttatgtaactacatattacttgtttctggtaatcaagtcttattttttaaaagcctattgtttttcagaattgagatatttaaaacttgttataacttcttcctaaaaatagaagagaagaggaggtactgtgtgttacaaaaatttttttaaataaaga

SEQ ID NO: 676 - DNA, 1325 bp, Homo sapiens
tctttgactcagtatattaatttctttggtgaataaatgtcaccggtcatttctttataaaagcattttggtaagagaaccagcaatatggagacagatttctccccgtggggtaggagtcgtggggtaggaggaaaatgaaataatttcggtacatcttatggtttaaagagtagaaaataagatgaaatatcctaaaatataggagcacagacatttaaaattcataatcaggctaacaacactctcttgaatttaggaatcattgaaaactccttgcacttagatttaatttatatgttagttacattattaaaagtcataaggcatttatctgagtcattgctctacagagagcaattaatggcttgtaataataaaaagaatatttctctgtaatgcattgttgaaagacaaccagaatatcaagaaaatgtatataggaatatgctacttgcctcctccctgcatttcctcgtggggcactatttgcgacataggcctacagaattagactttcatacttagaagataaggtacactcttcttcttttatttatttatttatttatttttaggccattcttctggtttgccaaattctattaagacagtgatacatttgcttccttatttatgcatgcttagatcatgaacatgatgcccttcttttttttttttttctttggtcaagtagggattaatgccataggtttagagagaaggattgttttcagtttttaagagaattttttaaaaatacattttatggttctcttaaggaattaatattcacttctgaaggacttacttgtaatatataatttatcattttagccagcagggaaataaatcatttttaatccccagaagaaagtgctggaaatagcttctatatagtcagcagttcacctggagaaagatcttaattccttgttgttttgactaggaatatcaatatttggtataaaataactagaatagtttattaccttttccctcatgaaattttaaatatatgcaaatatatatatcattagattcctgtggtggataataatttcttcagattctaaaacaggtgtctagtgactgcttaattgtttccaagttgcatcaaagatgaattggtaaataatggaaatgagtagtgatatgaaaatggttatgtaactacatattacttgtttctggtaatcaagtcttattttttaaaagcctattgtttttcagaattgagatatttaaaacttgttataacttcttcctaaaaatagaagagaagaggaggtactgtgtgttacaaaaatttttttaaataaaga

SEQ ID NO: 677 - DNA, 704 bp, Homo sapiens
agctcctccccctgcgtctctggcctcgccggtcttggggggatggttccatcatggcgtcaatgcagaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgggaaatttgaacacagagacatacacaaagggaagaagatgtgaagatacaggaagaatgtgaagatggtcatctataaaccaaagagaggcttgggacagaccctaccctctcagtcttcacaggacaacaaccctgcccgcaccttgatcttggacttctagcttccagagctgtgagaaaataaatgtctattgtttaagccaaaa

SEQ ID NO: 678 - DNA, 871 bp, Homo sapiens
ggggatcatggcgtcaatgcagaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgaactgaaatctgccttcatactatctattacggattgaatcatgtcctccaataagatgtgttgaagtcttaactcccagtacctcaaattgtgaccctatttggaaatagagtcattgcagatgtcattagttgaggtgaggttataccgaagtagaatgtggccttaatccaatataactggtgtcctaagaattggagaagagactcagacacatggggagaagaccatgcagtcatggggtgatgtatcaacaagccagcaaatgccagggattgctgggaacatcagaggctggaagaggcagggaaatgttcttccctagagctgtgggagagaacatgattctgctgacaccttgatcatggacttccagcctccagaactgtgagacaataaatgtctggtttcttttaagtct

SEQ ID NO: 679 - DNA, 4018 bp, Homo sapiens
agctcctccccctgcgtctctggcctcgccggtcttggggggatggttccatcatggcgtcaatgcagaccacaggaaggagggtggaagtatggtttccaaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgttttaacaaaagagtgtggacatttttattttaaaatttaggcaaaagtcactatcaaatggttgcttatttgtctcacacagccatatagtttttcctggagggttttgttttgttgttgttgaaaagactttgcttacagctagatgaaactttctatagaaaaaaaaaattgttgaaaggtccagttctcagtaccatgtgagttaatgatactacaactaagttctttttaaaaagtgattaatgtattttataaattaccttttcacatatgcaaaatctgtttctactacaatgttatttttactaatgccttattgttgcactctttttgaaatatcctgcagtgaatatatgaatcaatttgggcttaaaactgaaagccagttggctgaaaggtttgaaatacgtaccccagtaaaaccattcaatcaataattggtaaataatattttaaaattgtttttaatctgtatagatgacattttgtagctttgtacatgttgttaattaagggcatataattttacactcaaagtataattgctgaactcaggggtgggtagacttcaaaaatatgtctgctatagaaataacttgaaaaaaaaaattaaaaccgtggccagccaccaaattgtggacactgtttatatactgctagttaacaattaccacttttaaaaaattataaccgtttttgttctatcttgactagataaattctcacaatgatctctgtcagttttattagttggcctgtttaaccaagacagaaagtctttgaattactcatagttttaaactgcttttaatatgaaaattgcagctgtaaattatgtattttcatattttgcgtaactgctctacactactgtttgacttgatcttcttctgggggttagggagaaatctgtctccatattgctggttctcttaccaaaatgcttttataaagaaatgaccggtgacatttattcaccaaaggaattaatatactgagtcaaagattaacaatgctatactatagagtaataggtcatatatagcctcaattgagttttttatgacaatattttaacatacctctctctctacatataaataccataaagtaaactaaaatgacacagaggaaagtagaggaaaatgaaataatttcggtacatcttatggtttaaagagtagaaaataagatgaaatatcctaaaatataggagcacagacatttaaaattcataatcaggctaacaacactctcttgaatttaggaatcattgaaaactccttgcacttagatttaatttatatgttagttacattattaaaagtcataaggcatttatctgagtcattgctctacagagagcaattaatggcttgtaataataaaaagaatatttctctgtaatgcattgttgaaagacaaccagaatatcaagaaaatgtatataggaatatgctacttgcctcctccctgcatttcctcgtggggcactatttgcgacataggcctacagaattagactttcatacttagaagataaggtacactcttcttcttttatttatttatttatttatttttaggccattcttctggtttgccaaattctattaagacagtgatacatttgcttccttatttatgcatgcttagatcatgaacatgatgcccttcttttttttttttttctttggtcaagtagggattaatgccataggtttagagagaaggattgttttcagtttttaagagaattttttaaaaatacattttatggttctcttaaggaattaatattcacttctgaaggacttacttgtaatatataatttatcattttagccagcagggaaataaatcatttttaatccccagaagaaagtgctggaaatagcttctatatagtcagcagttcacctggagaaagatcttaattccttgttgttttgactaggaatatcaatatttggtataaaataactagaatagtttattaccttttccctcatgaaattttaaatatatgcaaatatatatatcattagattcctgtggtggataataatttcttcagattctaaaacaggtgtctagtgactgcttaattgtttccaagttgcatcaaagatgaattggtaaataatggaaatgagtagtgatatgaaaatggttatgtaactacatattacttgtttctggtaatcaagtcttattttttaaaagcctattgtttttcagaattgagatatttaaaacttgttataacttcttcctaaaaatagaagagaagaggaggtactgtgtgttacaaaaatttttttaaataaaga

SEQ ID NO: 680 - DNA, 1653 bp, Homo sapiens
agctcctccccctgcgtctctggcctcgccggtcttggggggatggttccatcatggcgtcaatgcagaaacgactacagaaagaactgttggctttgcaaaatgacccacctcctggaatgaccttaaatgagaagagtgttcaaaattcaattacacagtggattgtagacatggaaggtgcaccaggtaccttatatgaaggggaaaaatttcaacttctatttaaatttagtagtcgatatccttttgactctcctcaggtcatgtttactggtgaaaatattcctgttcatcctcatgtttatagcaatggtcatatctgtttatccattctaacagaagactggtccccagcgctctcagtccaatcagtttgtcttagcattattagcatgctttccagctgcaaggaaaagagacgaccaccggataattctttttatgtgcgaacatgtaacaagaatccaaagaaaacaaaatggtggtatcatgatgatacttgttgatgccactgttatcatcctcctagcagaagatagtcctactgagaaaatgagcactttgatcattcagtctttgaactttaacctttgactggaagtgacctataggcaatgaagactacttccttttactgcatttttactcgtgtgcattctgggcgcatgttgatcgctggttcagtccaggcaactgacatgcttttattagtcatacagtattaatgcaggtgtcaggaaatgtcaaatataattccattttttatttttatttttttaagcttttggaaaagctccaggtcctcatgtattgtgcaataacaatgacttccttggcggttttggtacgttcattgccggcaatgggcgttgtaacaggaaaagttttcattaactcctgccattcaatgattaatgcatgatagggcctatgaaatgaacttactggttatagtgggaatataaataaagtgagggatccaacattactttaaaagtcaccccaactgtttatatttggattctatgcactgtgatcctaaggttaacagcatgaattaacatgcgtctttaaaggactgtaatgaaagatcattgcatatttattgaattgtttatatctactgtcaagttgttttgacatggaagattttcaagtaacattggcagagaggtacagtatgttatccctatggtgaaaataaattaatttgttgtatatagttcctcaatctctgaagtaaaggtatgagtaatatagggtatgaatggtttaatcaaggctttattttggaagtaagaaaaatggcagtgatgattaaattgctgcagtccataatttgggcttgttatttgtacattaaagattttttccaagtaagttacactctgttaacttcctgctagccatcagcatgagccctactgcctaaacactatttcatttatttatgtttggaaaccccgtaaacatttttgtttgcaatcttgtttcttttgttataagtcaagtttgaatgttacaatacttttattgaaacttttgttaagttttttcttgtaaattttctttacttgtgagtatcatcttgtcctttaatcctgtaccctaaaataagaaatacatttttgacagaggcttaatgtttta

SEQ ID NO: 681 - DNA, 2482 bp, Homo sapiens
tttaaagttttaaagtttctaaaatgaaagctggccctgcctctctcccagagtgagcggagacagcggttgcatgagcagctttccttgtgaggccacaggtccctctggacacgctgctgcctgaccatgcctcctttccctttcagctttctcatagaccaatgggcttggagcattaaggccatacccctattatgcattctagtgcgaccttgtttacacctcccctggctcagtcacacagctgtgtggtaggctactagaagtgtttagtagttgtcactgggatcatgctgatgtggccccatccccgcctctccctgccctgtgatatcggaggaaacctgacagagcaaattggccatggccaagaaaaaggaaaagaaagagtgccaccaaaagcagggagccctaagggagcagttacaggtcctctttggattccagcacgacgcatcaaaccataccatgacgtgactaggacccaacctagaaatgaaggaactgaccctacaggactcacaaccctggataatgcagtgtcctcggacggcaacaagctctggacattacctgggggatgctgaaggcggcaactgaggaggctgaatgaatcctgctccagacacagacaccattcactccagataatttgttgcttgctatgctctctgttgtacattgcaactcgcatagggatgcaaagccggaataagagcaatgaccaccatgcctgacagacctgttgctgcgcacacctgtactctccaatgaacaagactgaatgcaaaaaaaacagaaaatggggagatttaggggatcagtcagtgtggttggaaaattgtaagatgaagttacaggatatagacacaaaccttcttggaaggccagaaggtttgcatagcttcagtaaaggatttggctgaaatcctttttacctctaatcccctttaccttgagttgatagcaatagagcaaataacatgggaatgtgggggagtttatctgaatagcttgtttactcatgtggtcctaagaccaacctttgattatccgcaggtgcatgattgctctctacctgggggcagggggagttaattacccacaggtggagctgaagagccaggaggctcagagtctgcagcagcagcaggaccagtacctgggtcatctgcagcagtatgtggccacctatcagcagcaggtggtcacctatcagcagctgacctctgaggaggaggagctgcacaaccagttactgctgcagacccagctcgtggaccggctgcagcagcagaaagctcaaagcaaagctgtggccaagatgggctgccaagagttgcgggagacccaggagcacctggaagctatcagccagcagaaccagcagcctcaggcccagttgagcctcatggctctccctggggaaggagatggacagtgaggaggaggaggaggtgcctcagcccatgccaagcatcccggaggatctagagagccagaaggccatggtggcatttttcaactcagctgtagctagtgccgaggaggagcaggcacggctatgtgggcagctgaaggagtgcactgccagcgcctggctcatctgttggcctcggcccagaaggaacctgaggcagcagcgtcacgcccacaagactgggggtgatcccatgtgtggggagacccaccaggccctgcagggggccatggagaagctgtgggagagtacatcgcactgtaccagagccagagggcagtgcggaaggaggaggagtgcatcagcaggctggcccaggacaagggagaggtgaaggtgaagctgctggagctggcgtggcttgtggacgactgcaacaagtggcatagcagattcctggcagctgcccagaaccctgctgatgagcccactccaggggcccccgccccccagtagcttggggctactgacaagccagggtagtgagtagagtccttagtggacagtgggcacgcaggagcaggggagggctcccacagcaccctgcctccctctctccaaagatctttgtgaggtgagccttgccagcagtggggagtctgcacaaggagaggcggggaagcattctccctgtgacaaccccactgagcagcagatcatgcaactgcttcatgagatgcagaacctccaggagcacccaggcttgggcagcagcccttgcattccttttttgtaccagactgatgagaacaatgaggtgaagatcaccatcatctaaaagccggccactgtcagcaaaacctggggaagtggggctggaggctctgcccctaccatgtccctaccaccccttcccagtcaaccctttaccctcacagtagcaagcataagacccctgtctaatgtggggagacaggtggagatgaggtgaagatcaccataatctaaaaggccactaaataaaaaaataaaaaattttaaaaaggtaggaaaaataaa

SEQ ID NO: 682 - DNA, 2596 bp, Homo sapiens
tttaaagttttaaagtttctaaaatgaaagctggccctgcctctctcccagagtgagcggagacagcggttgcatgagcagctttccttgtgaggccacaggtccctctggacacgctgctgcctgaccatgcctcctttccctttcagctttctcatagaccaatgggcttggagcattaaggccatacccctattatgcattctagtgcgaccttgtttacacctcccctggctcagtcacacagctgtgtggtaggctactagaagtgtttagtagttgtcactgggatcatgctgatgtggccccatccccgcctctccctgccctgtgatatcggaggaaacctgacagagcaaattggccatggccaagaaaaaggaaaagaaagagtgccaccaaaagcagggagccctaagggagcagttacaggagtctgaggatctggccagccgcctttagtattccaggcagtgtgtgggagagttggagcaggctctctgctgtctccacacagcagaagaaagcagacagggtgacggagctggactccatctcaaaacaaacaaacaaacaacaacaaaaaaaaaaacaaatgagaccatgggcttggaaatgccttgaaaaaatgtcaagtgtgattcagagtgaggaagtattactgtggaatagttactgtagctattgttaccggtcggccaactgctcctctgcctgctatatcctgacttaaccttggtctgtatttgccgtacaacaaggagttaaccaaagagagagacgccctcaggctggagttatacaagaacagttcattcctttctctactgcttctggccataaccgaagcaatgaggacctgaagcaggagaaatcagaattggaagagaagcttcaagtcctggtgactgagaaggctggcatgcagcttattttagaagagccgcaaaagaaattacaaatgatggcactcctgcttcaacaggctaggggttttcaaggcactgtgaagcccctgatgcgaaacagcagttaccgcaggccatggaggagcgggcacagctgaaagcacatctagggcaggtaatggagtcagttagataactacaaacggagagagatacgtatgctgaaaatctgaaaggagggagggccatgtggtgtcagaggaagcaacagatgtcggagcagcagggccctccaaggtggagcagcagctacaagcagaggctgaccacctgcagaaggagctggagagtctggcagctccgagcccaggagcaagacactgagggcttcagtcacccgaaccaggagtaggaggagaggctgctggagctggagcaggtggccgagctcttgcgggagcaggcagagtcacgcaggcaaatcctggagaccatgcagaacaaatgcaccaccatcagccacgtgctcacccagaaccacaagctcaaagagcagctgtctccgctgcagaacggattcataaagctggtgccacgggaggcagacaccaagttctggggtctccagctgcagtgggtggccgccaattgcttctctctgtccagactaatgagaacatggagatcaccagtgcactgcagttggaatagcacgtaaagagggagctgggaaagaagctgggcaagctaaaggacatggtaaccctgccccatccaagaagagctggaaggcgggcaccagcctctggggaggggaggtgtgaagccagaggcagctccagcctgggggacaggtgaccccagcaccctccagggcagtcctgtgactgtttcttgcttcccgccctctgacatttagtggtgggttcgttcttcctaggtctggacatcatcatcccagctggagtcatggagcctcccaaacatagggaaagagatggtggtataagaggttccttagagtcaaactagattccggccttggctccactggtcacctacttttcatctctaagtctcggtttctttaacttaaaagggaagttagcaccttcctcttggaggtgctgaggattaaatgagataatacgtggaaagcattaggcatgtagcacagttagcagatggtggttggctccctctgcttttccatcagtctgtggcctagtttaaatggtgggaggaagggtgtgagatttaaggctggttgtaagggatcagtcagtgtagttggaaaaattgtaagatgaagttataggatatagacacaaaccttcctggaaggccagaaagtctgcatagcttcaataaaggatttggctgaaagcagcgtaatcccctttaccttgagttgatagcaatagagcaaataacatgggaacgtgggggagtttattgaatagcttgtttactcatgtggtcctaagaccaacctttgattatccacgggtgcatgattgctctctactcggtggtcggcaaatttaattacccacaggtgtgttgactcaaagcctctgtcattaaatctatgctgaataaatgccgtcagggccagctagtcaaggtgcacaactctttttgtgcgtggtgtggccccttagctgctctgtcactgaaaaaaaatg

SEQ ID NO: 683 - DNA, 1512 bp, Homo sapiens
gtggaaggaagatgaccccaggtggccaggagcaggtgtgcacattgagagaggagaaggaggatagcatgagttgggtataagaacagtagatgagcttggctgaacagggccctccaaggtggagcagcagctacaagcagaggctgaccacctgcagaaggagctggagagtctggcagctccgagcccaggagcaagacactgagggcttcagtcacccgaaccaggagtaggaggagaggctgctggagctggagcaggtggccgagctcttgcgggagcaggcagagtcacgcaggcaaatcctggagaccatgcagaacaaatgcaccaccatcagccacgtgctcacccagaaccacaagctcaaagagcagctgtctccgctgcagaacggattcataaagctggtgccacgggaggcagacaccaagttctggggtctccagctgcagtgggtggccgccaattgcttctctctgtccagactaatgagaacatggagatcaccagtgcactgcagttggaatagcacgtaaagagggagctgggaaagaagctgggcaagctaaaggacatggtaaccctgccccatccaagaagagctggaaggcgggcaccagcctctggggaggggaggtgtgaagccagaggcagctccagcctgggggacaggtgaccccagcaccctccagggcagtcctgtgactgtttcttgcttcccgccctctgacatttagtggtgggttcgttcttcctaggtctggacatcatcatcccagctggagtcatggagcctcccaaacatagggaaagagatggtggtataagaggttccttagagtcaaactagattccggccttggctccactggtcacctacttttcatctctaagtctcggtttctttaacttaaaagggaagttagcaccttcctcttggaggtgctgaggattaaatgagataatacgtggaaagcattaggcatgtagcacagttagcagatggtggttggctccctctgcttttccatcagtctgtggcctagtttaaatggtgggaggaagggtgtgagatttaaggctggttgtaagggatcagtcagtgtagttggaaaaattgtaagatgaagttataggatatagacacaaaccttcctggaaggccagaaagtctgcatagcttcaataaaggatttggctgaaagcagcgtaatcccctttaccttgagttgatagcaatagagcaaataacatgggaacgtgggggagtttattgaatagcttgtttactcatgtggtcctaagaccaacctttgattatccacgggtgcatgattgctctctactcggtggtcggcaaatttaattacccacaggtgtgttgactcaaagcctctgtcattaaatctatgctgaataaatgccgtcagggccagctagtcaaggtgcacaactctttttgtgcgtggtgtggccccttagctgctctgtcactgaaaaaaaatg

SEQ ID NO: 684 - DNA, 1239 bp, Homo sapiens
tttaaagttttaaagtttctaaaatgaaagctggccctgcctctctcccagagtgagcggagacagcggttgcatgagcagctttccttgtgaggccacaggtccctctggacacgctgctgcctgaccatgcctcctttccctttcagctttctcatagaccaatgggcttggagcattaaggccatacccctattatgcattctagtgcgaccttgtttacacctcccctggctcagtcacacagctgtgtggtaggctactagaagtgtttagtagttgtcactgggatcatgctgatgtggccccatccccgcctctccctgccctgtgatatcggaggaaacctgacagagcaaattggccatggccaagaaaaaggaaaagaaagagtgccaccaaaagcagggagccctaagggagcagttacaggtcctctttggattccagcacgacgcatcaaaccataccatgacgtgactaggacccaacctagaaatgaaggaactgaccctacaggactcacaaccctggataatgcagtgtcctcggacggcaacaagctctggacattacctgggggatgctgaaggcggcaactgaggaggctgaatgaatcctgctccagacacagacaccattcactccagataatttgttgcttgctatgctctctgttgtacattgcaactcgcatagggatgcaaagccggaataagagcaatgaccaccatgcctgacagacctgttgctgcgcacacctgtactctccaatgaacaagactgaatgcaaaaaaaacagaaaatggggagatttaggggatcagtcagtgtggttggaaaattgtaagatgaagttacaggatatagacacaaaccttcttggaaggccagaaggtttgcatagcttcagtaaaggatttggctgaaatcctttttacctctaatcccctttaccttgagttgatagcaatagagcaaataacatgggaatgtgggggagtttatctgaatagcttgtttactcatgtggtcctaagaccaacctttgattatccgcaggtgcatgattgctctctacctgggggcagggggagttaattacccacaggtgtgttgactcaaagcctttgtcattaagtctgtgctgaataaatgccatgagggccagccagttaaggcctgtggccgccacaactctttctgtgcatggcccggccccttagctgctctgtcact

SEQ ID NO: 685 - DNA, 1706 bp, Homo sapiens
tttaaagttttaaagtttctaaaatgaaagctggccctgcctctctcccagagtgagcggagacagcggttgcatgagcagctttccttgtgaggccacaggtccctctggacacgctgctgcctgaccatgcctcctttccctttcagctttctcatagaccaatgggcttggagcattaaggccatacccctattatgcattctagtgcgaccttgtttacacctcccctggctcagtcacacagctgtgtggtaggctactagaagtgtttagtagttgtcactgggatcatgctgatgtggccccatccccgcctctccctgccctgtgatatcggaggaaacctgacagagcaaattggccatggccaagaaaaaggaaaagaaagagtgccaccaaaagcagggagccctaagggagcagttacaggtcctctttggattccagcacgacgcatcaaaccataccatgacgtgactaggacccaacctagaaatgaaggaactgaccctacaggactcacaaccctggataatgcagtgtcctcggacggcaacaagctctggacattacctgggggatgctgaaggcggcaactgaggaggctgaatgaatcctgctccagacacagacaccattcactccagataatttgttgcttgctatgctctctgttgtacattgcaactcgcatagggatgcaaagccggaataagagcaatgaccaccatgcctgacagacctgttgctgcgcacacctgtactctccaatgaacaagactgaatgcaaaaaaaacagaaaatggggagatttaggggatcagtcagtgtggttggaaaattgtaagatgaagttacaggatatagacacaaaccttcttggaaggccagaaggtttgcatagcttcagtaaaggatttggctgaaatcctttttacctctaatcccctttaccttgagttgatagcaatagagcaaataacatgggaatgtgggggagtttatctgaatagcttgtttactcatgtggtcctaagaccaacctttgattatccgcaggtgcatgattgctctctacctgggggcagggggagttaattacccacaggtggagctgaagagccaggaggctcagagtctgcagcagcagcaggaccagtacctgggtcatctgcagcagtatgtggccacctatcagcagcaggtggtcacctatcagcagctgacctctgaggaggaggagctgcacaaccagttactgctgcagacccagctcgtggaccggctgcagcagcagaaagctcaaagcaaagctgtggccaagatgggctgccaagagttgcgggagacccaggagcacctggaagctatcagccagcagaaccagcagcctcaggcccagttgagcctcatggctctccctggggaaggtaccggagactgctcacaggaagaggagagagccccaggaggaaacgggaactgttagcagcataggattgaggagctgaaacagacttttagaacagctggtcattatgccaaccaggagatggacagtgaggaggaggaggaggtgcctcagcccatgccaagcatcccggaggatctgcatcagcctgtttcaagaacaggctgatgccactaccccttgattttccatcttaaaatatacatgtttatgtaaacaaatctctccatat

SEQ ID NO: 686 - DNA, 414 bp, Homo sapiens
gtattgactgagttgtacattaagcctagccctagcccttttaaggtgcactgtgtggaacggcccaggctccccaaatctaaacttctcactcttcaccatccagttttcaaggcactgtgaagcccctgatgcgaaacagcagttaccgcaggccatggaggagcgggcacagctgaaagcacatctagggcaggtgaagctttgcaggggagggatgtggaaggaagatgaccccaggtggccaggagcaggtgaggaccagtgacagccctttgtaacttttgtacccattctttaaggtaatggagtcagttagataactacaaacggagagagatacgtatgctgaaaatctgaaaggagggagggccatgtggtgtcagaggaagcaacagatgtcggagcaggtga

SEQ ID NO: 687 - DNA, 411 bp, Homo sapiens
ccaggagcaggtgaggaccagtgacagccctttgtaacttttgtacccattctttaaggtaatggagtcagttagataactacaaacggagagagatacgtatgctgaaaatctgaaaggagggagggccatgtggtgtcagaggaagcaacagatgtcggagcaggtgagacctgacccttcagccccccaccttagatagatcacttgatctttctaggcatctgtaaaatgggaagactatagccagagttggtcatgggtctgggctgtgtgaaggcaaggtcagagagggagatggtagcctatccagccaccagcccttctcttcagtgccctttccctctgtattttgggcaggtgtgcacattgagagaggagaaggaggatagcatgagttgggtataagaa

SEQ ID NO: 688 - DNA, 711 bp, Homo sapiens
ggggaagagggaatgatttttctaacctgcctccacccttccaggtgccacgggaggcagacaccaagttctggggtctccagctgcagtgggtggccgccaattgcttctctctgtccagactaatgagaacatggagatcaccagtgcactgcagttggaatagcacgtaaagagggagctgggaaagaagctgggcaagctaaaggacatggtaaccctgccccatccaagaagagctggaaggcgggcaccagcctctggggaggggaggtgtgaagccagaggcagctccagcctgggggacaggtgaccccagcaccctccagggcagtcctgtgactgtttcttgcttcccgccctctgacatttagtggtgggttcgttcttcctaggtctggacatcatcatcccagctggagtcatggagcctcccaaacatagggaaagagatggtggtataagaggttccttagagtcaaactagattccggccttggctccactggtcacctacttttcatctctaagtctcggtttctttaacttaaaagggaagttagcaccttcctcttggaggtgctgaggattaaatgagataatacgtggaaagcattaggcatgtagcacagttagcagatggtggttggctccctctgcttttccatcagtctgtggcctagtttaaatggtgggaggaagggtgtgaga

SEQ ID NO: 689 - DNA, 1384 bp, Homo sapiens
gcagaggtgggcccactctgcccttgttgggttgtctgaggacctctctggccacccccaacaggagatggacagtgaggaggaggaggaggtgcctcagcccatgccaagcatcccggaggatctagagagccagaaggccatggtggcatttttcaactcagctgtagctagtgccgaggaggagcaggcacggctatgtgggcagctgaaggagtgcactgccagcgcctggctcatctgttggcctcggcccagaaggaacctgaggcagcagcgtcacgcccacaagactgggggtgatcccatgtgtggggagacccaccaggccctgcagggggccatggagaagctgtgggtgagtctttcctggcatgggccaagaagggttggggcaggaaggtcgctgccttaatgtgaccccattattttggctccagagccgctttatggagctcatgcaggagagaaggtggacttgaaggagagggttgaggaactggaacattgctgcatctagctgtctggagagagacagacaccatcggggagtgggaagccagggcacggcaaagagagctgcacattggtcagaggggccccagcgtctgagtcctgtcctcctgcaggagagtacatcgcactgtaccagagccagagggcagtgcggaaggaggaggagtgcatcagcaggctggcccaggacaagggagaggtgaaggtgaagctgctggagctggcgtggcttgtggacgactgcaacaagtggcatagcagattcctggcagctgcccagaaccctgctgatgagcccactccaggggcccccgccccccagtagcttggggctactgacaagccagggtagtgagtagagtccttagtggacagtgggcacgcaggagcaggggagggctcccacagcaccctgcctccctctctccaaagatctttgtgaggtgagccttgccagcagtggggagtctgcacaaggagaggcggggaagcattctccctgtgacaaccccactgagcagcagatcatgcaactgcttcatgagatgcagaacctccaggagcacccaggcttgggcagcagcccttgcattccttttttgtaccagactgatgagaacaatgaggtgaagatcaccatcatctaaaagccggccactgtcagcaaaacctggggaagtggggctggaggctctgcccctaccatgtccctaccaccccttcccagtcaaccctttaccctcacagtagcaagcataagacccctgtctaatgtggggagacaggtggagatgaggtgaagatcaccataatctaaaaggccactaaataaaaaaataaaaaattttaaaaaggtaggaaaaataaa

SEQ ID NO: 690 - DNA, 2671 bp, Homo sapiens
tttaaagttttaaagtttctaaaatgaaagctggccctgcctctctcccagagtgagcggagacagcggttgcatgagcagctttccttgtgaggccacaggtccctctggacacgctgctgcctgaccatgcctcctttccctttcagctttctcatagaccaatgggcttggagcattaaggccatacccctattatgcattctagtgcgaccttgtttacacctcccctggctcagtcacacagctgtgtggtaggctactagaagtgtttagtagttgtcactgggatcatgctgatgtggccccatccccgcctctccctgccctgtgatatcggaggaaacctgacagagcaaattggccatggccaagaaaaaggaaaagaaagagtgccaccaaaagcagggagccctaagggagcagttacaggtcctctttggattccagcacgacgcatcaaaccataccatgacgtgactaggacccaacctagaaatgaaggaactgaccctacaggactcacaaccctggataatgcagtgtcctcggacggcaacaagctctggacattacctgggggatgctgaaggcggcaactgaggaggctgaatgaatcctgctccagacacagacaccattcactccagataatttgttgcttgctatgctctctgttgtacattgcaactcgcatagggatgcaaagccggaataagagcaatgaccaccatgcctgacagacctgttgctgcgcacacctgtactctccaatgaacaagactgaatgcaaaaaaaacagaaaatggggagatttaggggatcagtcagtgtggttggaaaattgtaagatgaagttacaggatatagacacaaaccttcttggaaggccagaaggtttgcatagcttcagtaaaggatttggctgaaatcctttttacctctaatcccctttaccttgagttgatagcaatagagcaaataacatgggaatgtgggggagtttatctgaatagcttgtttactcatgtggtcctaagaccaacctttgattatccgcaggtgcatgattgctctctacctgggggcagggggagttaattacccacaggtggagctgaagagccaggaggctcagagtctgcagcagcagcaggaccagtacctgggtcatctgcagcagtatgtggccacctatcagcagcaggtggtcacctatcagcagctgacctctgaggaggaggagctgcacaaccagttactgctgcagacccagctcgtggaccggctgcagcagcagaaagctcaaagcaaagctgtggccaagatgggctgccaagagttgcgggagacccaggagcacctggaagctatcagccagcagaaccagcagcctcaggcccagttgagcctcatggctctccctggggaaggagatggacagtgaggaggaggaggaggtgcctcagcccatgccaagcatcccggaggatctagagagccagaaggccatggtggcatttttcaactcagctgtagctagtgccgaggaggagcaggcacggctatgtgggcagctgaaggagtgcactgccagcgcctggctcatctgttggcctcggcccagaaggaacctgaggcagcagcgtcacgcccacaagactgggggtgatcccatgtgtggggagacccaccaggccctgcagggggccatggagaagctgtggagccgctttatggagctcatgcaggagagaaggtggacttgaaggagagggttgaggaactggaacattgctgcatctagctgtctggagagagacagacaccatcggggagtgggaagccagggcacggcaaagagagctgcacattggtcagaggggccccagcgtctgagtcctgtcctcctgcaggagagtacatcgcactgtaccagagccagagggcagtgcggaaggaggaggagtgcatcagcaggctggcccaggacaagggagaggtgaaggtgaagctgctggagctggcgtggcttgtggacgactgcaacaagtggcatagcagattcctggcagctgcccagaaccctgctgatgagcccactccaggggcccccgccccccagtagcttggggctactgacaagccagggtagtgagtagagtccttagtggacagtgggcacgcaggagcaggggagggctcccacagcaccctgcctccctctctccaaagatctttgtgaggtgagccttgccagcagtggggagtctgcacaaggagaggcggggaagcattctccctgtgacaaccccactgagcagcagatcatgcaactgcttcatgagatgcagaacctccaggagcacccaggcttgggcagcagcccttgcattccttttttgtaccagactgatgagaacaatgaggtgaagatcaccatcatctaaaagccggccactgtcagcaaaacctggggaagtggggctggaggctctgcccctaccatgtccctaccaccccttcccagtcaaccctttaccctcacagtagcaagcataagacccctgtctaatgtggggagacaggtggagatgaggtgaagatcaccataatctaaaaggccactaaataaaaaaataaaaaattttaaaaaggtaggaaaaataaa

SEQ ID NO: 691 - DNA, 2413 bp, Homo sapiens
aatttttaaaatttagatgacaaatttcagtccattgtagaaaagcactttgctaaaacctctcaagacataaaactgcagttttatggaaatatgtgaacagtaatgtatgatgtggtccaaatgaattgttaacttggggaagaggatatgcttgtgttcacaccccctcaggtcctctttggattccagcacgacgcatcaaaccataccatgacgtgactaggacccaacctagaaatgaaggaactgaccctacaggactcacaaccctggataatgcagtgtcctcggacggcaacaagctctggacattacctgggggatgctgaaggcggcaactgaggaggctgaatgaatcctgctccagacacagacaccattcactccagataatttgttgcttgctatgctctctgttgtacattgcaactcgcatagggatgcaaagccggaataagagcaatgaccaccatgcctgacagacctgttgctgcgcacacctgtactctccaatgaacaagactgaatgcaaaaaaaacagaaaatggggagatttaggggatcagtcagtgtggttggaaaattgtaagatgaagttacaggatatagacacaaaccttcttggaaggccagaaggtttgcatagcttcagtaaaggatttggctgaaatcctttttacctctaatcccctttaccttgagttgatagcaatagagcaaataacatgggaatgtgggggagtttatctgaatagcttgtttactcatgtggtcctaagaccaacctttgattatccgcaggtgcatgattgctctctacctgggggcagggggagttaattacccacaggtggagctgaagagccaggaggctcagagtctgcagcagcagcaggaccagtacctgggtcatctgcagcagtatgtggccacctatcagcagcaggtggtcacctatcagcagctgacctctgaggaggaggagctgcacaaccagttactgctgcagacccagctcgtggaccggctgcagcagcagaaagctcaaagcaaagctgtggccaagatgggctgccaagagttgcgggagacccaggagcacctggaagctatcagccagcagaaccagcagcctcaggcccagttgagcctcatggctctccctggggaaggagatggacagtgaggaggaggaggaggtgcctcagcccatgccaagcatcccggaggatctagagagccagaaggccatggtggcatttttcaactcagctgtagctagtgccgaggaggagcaggcacggctatgtgggcagctgaaggagtgcactgccagcgcctggctcatctgttggcctcggcccagaaggaacctgaggcagcagcgtcacgcccacaagactgggggtgatcccatgtgtggggagacccaccaggccctgcagggggccatggagaagctgtggagccgctttatggagctcatgcaggagagaaggtggacttgaaggagagggttgaggaactggaacattgctgcatctagctgtctggagagagacagacaccatcggggagtgggaagccagggcacggcaaagagagctgcacattggtcagaggggccccagcgtctgagtcctgtcctcctgcaggagagtacatcgcactgtaccagagccagagggcagtgcggaaggaggaggagtgcatcagcaggctggcccaggacaagggagaggtgaaggtgaagctgctggagctggcgtggcttgtggacgactgcaacaagtggcatagcagattcctggcagctgcccagaaccctgctgatgagcccactccaggggcccccgccccccagtagcttggggctactgacaagccagggtagtgagtagagtccttagtggacagtgggcacgcaggagcaggggagggctcccacagcaccctgcctccctctctccaaagatctttgtgaggtgagccttgccagcagtggggagtctgcacaaggagaggcggggaagcattctccctgtgacaaccccactgagcagcagatcatgcaactgcttcatgagatgcagaacctccaggagcacccaggcttgggcagcagcccttgcattccttttttgtaccagactgatgagaacaatgaggtgaagatcaccatcatctaaaagccggccactgtcagcaaaacctggggaagtggggctggaggctctgcccctaccatgtccctaccaccccttcccagtcaaccctttaccctcacagtagcaagcataagacccctgtctaatgtggggagacaggtggagatgaggtgaagatcaccataatctaaaaggccactaaataaaaaaataaaaaattttaaaaaggtaggaaaaataaa

SEQ ID NO: 692 - DNA, 927 bp, Homo sapiens
ctcacaaaacctgcatataaatgtttgcagtagatttagtagatttgctagtcatgtctaaaactggaaacaacccagatgtttttcagagtgaatggttaaacacatatggtcctaccatatcacggaatactactcagcaataagaaagaacaaacaatacaaccaggaatctccagagaattatgttaattgtaaaagccaatcctaaaaggtggcttattatatgatttcatttatatgacagtctttaaaatgcaaagttataaaaatggaaaatagattactggttgtttggggtttaggagggagtggaagtgggagagaggtgagggcaattataaaagagcaacataaggaagccttgtgatgatggaaacgttctgtatcttgactgtgccattatcaatgtcccaattgtgatattttactatagtattgcaagatgctatcattgaggaaaacggggtaaagggtacagggggtcacactgtattatttcttacaagggcatgtgaattttcaattatctcaaagtaaaagtttcaattaaatagatagcatcttttaaatgcaagaataggaggttattttgtgtactggtggcaggcaaaagtttcttttttcttaatatagtttataaagaaaatagatacattaaatatcaaaattaataccttttgttgatcaaaataaatatacccttaagaaaatgaataggcaaggcagaatttgtagaaaacaaatcaaacaaaacgtatatccacaatctatgtctatacctatacttcattttttatttttcataaataaaaataaaacaataaaaggtgggcagaataactggcaagaaactttatgaacatttatgaatgcccaaaaaaagacatacaagtctttatcctcatcatttattgaataaataca

SEQ ID NO: 693 - DNA, 1044 bp, Homo sapiens
gacagagcaagactccgtctcaaaaagaataggagacacagtgagacgaccatgagaagccagagagaaaacagccatcttacaagccaagagagaagttgtgagaaaaaaaaaaaaaaacaaaccctgctgactccttgatttttgccttccaagctccagaactgtgaggaaataaatgtctgttgttttagccaccaaacctggtaaggcagtcctagcaagctaatacaatagcctgttccttaataaacaactgcaagatttagtttatagaaaccagctcggaagcagttggtttagaatgactttcctaggaatctggtcaagaaaggaacttactaaaagactattctcatttaacaaaagagatattaagtatctcaaaggccaaatctttaaaaagattatctgttttaagccacaaaacatttgtgtggatccctttgcagcaagtttgctcttagataagattcagtcttcgttctcagctgttgcaggttaaggcttgtgaaatgatccaaaaagggaacagcagcttttggagaaaacttttatttgttcttcattctagtgtcaagtttaaaggcttgaagtcagaatgttagaagtggggaaggggaccttagaggtgacgtcttccagatgttcctgtttatgcacaaggggacagtctcggagaattaaggcgcaaaactcgggtcccaatttctaggtaggttcctgtttgttctgctgctatcgtgcgcttatggtgactgtgtgaatccaaccaaaacggaggttccgtatgccagtggggcaacgtttttcagctgcaaatcttgggaaatcaaaagcaaggctgttttttttttcttttcttttttgagacagagtttcactcttgttgcccaggctggagtgcaatggcgcaatctcagctcactgcaacctccacctcccaggttcaagagaatcgcttgaacccgggaggcagagattgcactgagctgaggtcatgccactgcactccagcctggcaacagggcaagactccatctc

SEQ ID NO: 694 - DNA, 710 bp, Homo sapiens
ttctccaagaccattcagtcgtgaagggttcaacttgttccgggttatttatttagcattctctattttctgctttgcttttgacactccaatgtttaattgtatatttaggaaataacaatgaagagtacgtttttaaaaagaagaatgttttctggaagggatttccccccacttttggacagtgagttagactccttctgaagcctctggatctaggttattacagggtttgtcttcttgaagctggaactgtccaactgttgtgctatttcagacctggcctgtctttcactttcaagctccagaaataatttatagctgtagggtgtcaggagtgggtttgaactgggcctgcccaacgtaacatggaattgtgcacagatggttaaaattactatttctgcattcaaatgactaagtacagtaaactttttactggcacagttaatttatttgaatatttatgggtcgagtgcttcacgtagaagactaacataatgaaaaagcccagcacatactcagagctgatttggctttttaaaagattctaggcttgaatatagctagctaaatggtctttagcaaattgactggcagtaaattgatccctgtggactgtggcttgaatcagcctctcattctttaaaggtattatggagatatggttatctcagcgcaaggctggtctagaaaagggatgctttcag

SEQ ID NO: 695 - DNA, 534 bp, Homo sapiens
tccctgaagtggctgctatccaggatgactgtgttgctgcagtctttgagtggttggagcgctgtaatgtctatgttaatagctgggaaatcgcagtagcagcaaccagaccactccaatggaacaatccaagttggggtaagtttgattgagcaaaaaagtcatgctgactgtgtgatgaagaggcagaactggtaacagtgacaggccctgcagtcagcagctgtggattttatgtgcagggcagactgatctggaaaatgggaagagctgactgccaataacaccttggggggaggtttgttcagtgcatctccctactccttgtatacctctgatgacatgcagaagcttaggaaataaaacacacttgtaacatcacagggtgcaagtaagtacatgtggatgccagtgtagagagaagcgaaagctagttttcattgcaagaatccaaacagagtaacagggctttgtccactgtctccagtccatggttccctggtgttcctagagtcctattaaaaaaaaaaaaaa

SEQ ID NO: 696 - DNA, 549 bp, Homo sapiens
tcaattagatagctgtattggggaaaaaagtagaccccttccttgataccatatatatagaaaaatcaattccatgtggaatatggtttaaatgcgaaaggaaataatgaaacaggagagtgtcttcatgttttggggtaggcaactatttaaaggacataaagcataaaggaacattttaaactaatttgtggtgatagaatcagggtagaggttatcactcgcctggcaaaattaatcaataagaaaagataacttagccagacacagtggctcatgcctgtaatcctagcactgggaggctgaggcatgaggatagcttaagaccaggagttcaagactagcctgggcaacatagtgagaccttgtctctacaaaaattttaaaaattaactgggtgcagtggcatgcacttgtagtcccagttacttggcaggctggggcaggaggatcatctgagcccaggagtttgagcctgcagtgaactataattgtgtcactacactccagcctgggcaacagagcaagaccctgcctgtctaaaattaa

SEQ ID NO: 697 - DNA, 294 bp, Homo sapiens
tccgccggactcgcacaacactccgccgcactcgcacaagactccgccgcggcgacctctactgaaagacccccagtcctggtgtcgcccgaaggcccaggaaaccgtgcttccgcgcttctcccccagaacgtgggaagctgccgctttaccctcattttaccccagggtcgcaaaacatctcaccgtagttgaagccagcaagccggaccaggcgtcccggccaagcaacgtgcgcgcccccccgcgagtgctcgccccgcccctagggaggagccggccgacccccggcca

SEQ ID NO: 698 - DNA, 2248 bp, Homo sapiens
ggcagccgcagaagcggcagcggcggcggcgcggcgcaggcaccggcccggggagaggcaccatgagcggatcacagaacaatgacaaaagacaatttctgctggagcgactgctggatgcagtgaaacagtgccagatccgctttggagggagaaaggagattgcctcggattccgacagcagggtcacctgtctgtgtgcccagtttgaagccgtcctgcagcatggcttgaagaggagtcgaggattggcactcacagcggcagcgatcaagcaggcagcgggctttgccagcaaaaccgaaacagagcccgtgttctggtactacgtgaaggaggtcctcaacaagcacgagctgcagcgcttctactccctgcgccacatcgcctcagacgtgggccggggtcgcgcctggctgcgctgtgccctcaacgaacactccctggagcgctacctgcacatgctcctggccgaccgctgcaggctgagcactttttatgaagactggtcttttgtgatggatgaagaaaggtccagtatgcttcctaccatggcagcaggtctgaactccatactctttgcgattaacatcgacaacaaggatttgaacgggcagagtaagtttgctcccaccgtttcagacctcttaaaggagtcaacgcagaacgtgacctccttgctgaaggagtccacgcaaggagtgagcagcctgttcagggagatcacagcctcctctgccgtctccatcctcatcaaacctgaacaggagaccgaccccttgcctgtcgtgtccaggaatgtcagtgctgatgccaaatgcaaaaaggagcggaagaagaaaaagaaagtgaccaacataatctcatttgatgatgaggaagatgagcagaactctggggacgtgtttaaaaagacacctggggcaggggagagctcagaggacaactccgaccgctcctctgtcaatatcatgtccgcctttgaaagccccttcgggcctaactccaatggaagtcagagcagcaactcatggaaaattgattccctgtctttgaacggggagtttgggtaccagaagcttgatgtgaaaggcatcgatgatgaagatgtggatgaaaacgaagatgacgtgtatggaaactcatcaggaaggaagcacaggggccactcggagtcgcccgagaagtaagtttgtgtgtaaggtggagtctcaccgtcccccaggctggagtgccgtggcgtgatctcagctcactgcaacctccacctcccgggttcaggctattctcctgcctcagcctcccgagtagctgggattacaggcacctgtcaccacacccagctaatttttgtatttttagtggggatggggtttcaccatgttggccaggctggtctcaaactcctgacctcaggtgatctgcctgccttggcctcccagattgctgggtttacaggcatgagccaccacgcccagccttcccttgcacttttaatgagggggttaagttcactgttttctctttctatggtattgggtaaaataggtctgcaagctttatatttgcccagggtatcattcattcttcagttgttgatttaggagtgttatttggaaggagtattatttgctcttcccctgagaactgaaagaggggaagggagtacatttgagggcacttaatacaaagttaatgtcagaatgtgtgccttgaaattcttgctttatacatacatctgtcattttcatttcacagggttcacagggtttcacagtctgatgagactgtgcctgttattgttttttatttttactctggattttccttgcatctgacttgccactagcacaggaagctcaggacgaaggcagcgttaggagaatagttgtggtatggtgacttctgtgtttatctgcaggagtgtgaatagccgtaacttgcctgcacctgctgccttaacagtggagttggccaggcgcagtggctcacacctgtaatcccagcactttgggacaccagggtgggtggatcacctgaggtcaggagttctagaccagcctgaccaacatggtgaaaccccttctctacgtataaaaaaatacaaaattagccaggcatggtggtgcatgcctgtaactccagatacttgggatgctgaggcaggagaatcgcttgaatatgagaggcggagccaagatgatgccattgcactccagcctgggcaacaagagagaaggtccttctc

SEQ ID NO: 699 - DNA, 1061 bp, Homo sapiens
aattcaggatccagctctgtcacccaggctggagtgcagtatctaagtatcatttctcttacttcaaattattacattttattctgtacattgattctgaactcctaatataatatttatgtcctgtatttgcagcccattggttttttttaaagtcataaatctaaatgatgccagaaaatcaaagatgccccagatgttgggcttctcttttgccagccacattggtagcactctcctgccttggcctcccagattgctgggtttacaggcatgagccaccacgcccagccttcccttgcacttttaatgagggggttaagttcactgttttctctttctatggtattgggtaaaataggtctgcaagctttatatttgcccagggtatcattcattcttcagttgttgatttaggagtgttatttggaaggagtattatttgctcttcccctgagaactgaaagaggggaagggagtacatttgagggcacttaatacaaagttaatgtcagaatgtgtgccttgaaattcttgctttatacatacatctgtcattttcatttcacagggttcacagggtttcacagtctgatgagactgtgcctgttattgttttttatttttactctggattttccttgcatctgacttgccactagcacaggaagctcaggacgaaggcagcgttaggagaatagttgtggtatggtgacttctgtgtttatctgcaggagtgtgaatagccgtaacttgcctgcacctgctgccttaacagtggagttggccaggcgcagtggctcacacctgtaatcccagcactttgggacaccagggtgggtggatcacctgaggtcaggagttctagaccagcctgaccaacatggtgaaaccccttctctacgtataaaaaaatacaaaattagccaggcatggtggtgcatgcctgtaactccagatacttgggatgctgaggcaggagaatcgcttgaatatgagaggcggagccaagatgatgccattgcactccagcctgggcaacaagagagaaggtccttctc

SEQ ID NO: 700 - DNA, 909 bp, Homo sapiens
ggcagccgcagaagcggcagcggcggcggcgcggcgcaggcaccggcccggggagaggcaccatgagcggatcacagaacaatgacaaaagacaatttctgctggagcgactgctggatgcagtgaaacagtgccagatccgctttggagggagaaaggagattgcctcggattccgacagcagggtcacctgtctgtgtgcccagtttgaagccgtcctgcagcatggcttgaagaggagtcgaggattggcactcacagcggcagcgatcaagcaggcagcgggctttgccagcaaaaccgaaacagagcccgtgttctggtactacgtgaaggaggtcctcaacaagcacgagctgcagcgcttctactccctgcgccacatcgcctcagacgtgggccggggtcgcgcctggctgcgctgtgccctcaacgaacactccctggagcgctacctgcacatgctcctggccgaccgctgcaggctgaggtacgtggccgggatgcgaactgggatgggatggagcaagaggtgaagatcttggagtctggaatcagaccacctggattttcatcctagttccccgatctgggggaagtgggcctccctctgacagctccggagtgttctgctgagctgtggagaaacttgggggagaatcattgagagactgcctgtaaagggctcagcatggcacttgcatacagccagcttggatgtggagagagctgttgtcttaggacatagcttcctcttcactttctggattttttttttttttttaaagacagggtcttgctttgttgcccaagttggagtgcagtggcatgaacatgggtctttgcagcctggacctccctggctcaagcaatcctcccaccttagcctcctgagcagctaggacccta

SEQ ID NO: 701 - DNA, 598 bp, Homo sapiens
ggcagccgcagaagcggcagcggcggcggcgcggcgcaggcaccggcccggggagaggcaccatgagcggatcacagaacaatgacaaaagacaatttctgctggagcgactgctggatgcagtgaaacagtgccagatccgctttggagggagaaaggagattgcctcggattccgacagcagggtcacctgtctgtgtgcccagtttgaagccgtcctgcagcatggcttgaagaggagtcgaggattggcactcacagcggcagcgatcaagcaggcagcgggctttgccagcaaaaccgaaacagagcccgtgttctggtactacgtgaaggaggtcctcaacaagcacgagctgcagcgcttctactccctgcgccacatcgcctcagacgtgggccggggtcgcgcctggctgcgctgtgccctcaacgaacactccctggagcgctacctgcacatgctcctggccgaccgctgcaggctgagcactttttatgaagactggtcttttgtgatggatgaagaaaggtccagtatgcttcctaccatggcagcagggtcggaacgccagtacatcggagtcccacaggcgaa

SEQ ID NO: 702 - DNA, 443 bp, Homo sapiens
ggcatatagtaaatgttcaataaatggtagctatgattgtcatcaactcaaacagcctcccttcattcacctttacctcataaagcaactctttctagaatgttctatatataacaattgtattaaaggcttcttgaaggagaagccatttgtttgtgtctttgttcaacaccaggctcctgatgctttcagtagtgtctggcgcacagcaggcatttaaaaaatatttgttaaatgaattttatagaattaagtctatcacactcttttgagtactaaaatgctattatagtctgtggataaaaataataaaacaaggccaggcgcagtggctcacacctgtaatcccagcactttgggaggccgaggtgggtggatcatgaggtcaggagattgagaccatcctggctaacacggtgaaaccccgtctctactaaaaatac

SEQ ID NO: 703 - DNA, 284 bp, Homo sapiens
caagagtgaaattccttctcaaaaaaaaaaaaaaaaaaaaaaaagaggaggaaaaagaagaactaatctgattgttgttgcatggggggcaactttgagccttctccttggaacatgaggacctcattgtacatatttgaaccactgggataacaacagtaaaaatagtcatagtagaattagccaacagtcactgaacatttactgtgagcttggtactcttccagacttcatatttattatctcatttatttcttaacctcatgaaatcaggactataattc

SEQ ID NO: 704 - DNA, 427 bp, Homo sapiens
gacacagctcagccacactgcagcctcagctctcgggacactacagatccctcacagtcactcgacaaacacacatgggtcgtgcccagtgctcactggagactctgccctccccaggtcacagtctgatcacttcaaaggagaactgggtgagtactagggtaggggtcctgaaaagggtcgtggagtaggaattctggggtcctgagccctgctctcacaccagctccagacagggcacagcctgtgagagcaactgagggggctcagtgacgagggcttggggtgtctgccccatggcagcattgacggcattgtggggacacttggaggtgcccagtggacccccactgacgtgggtgtaaaatccttaggtagggttgtgtggttttttttgttttgttttgtttttgagacagggtctcgc

SEQ ID NO: 705 - DNA, 469 bp, Homo sapiens
ttatggtcaggactgcccccatctataaagctgctaatgcccaagccttaaaggggaaagataaacaccagctgccagtcttttggttgtacaacatggaggcctgaacaacaagagcttcttctatattagtttcatgatgctttgttcctgaagtcaggaagtaccttgccagtaagggaatgccttttaattttcttttgatattggacaatgcccttggtcacccagaaccccatgagttcaacactgaaagccatgaaatggtctcttttcccccaagcacaatgtctccaagtcagcatgtagattaaagggtcataagtacctttaaggctcattacagaggatgctatatggaaaggattattaatgctgtggaagagaacccccaatagagaggacatcatacatgtttagaaggattcaaaatcctgttgaagataccattgttgctacagaaaaatcc

SEQ ID NO: 706 - DNA, 416 bp, Homo sapiens
agttataaaaatcctaatggctgatatgcactccagaagtcataaatgagtatgttttgtttggttcatatcttgttttgttgcccactgaatacctttagactgggctaaagactaggttgtctttagttctttacagttctgtatctcatttattcctggcccttatctataaatttatattacctgcttgggtccccatgggtatctgaatttggagcctctggcatacattgtacagcaggttcagaagaatgcacaataatatataagcttcccgagtctttcagcattatagaagtcacagaaaacttacttggattccaagtaatttctattttgagtctttgttcctccaggtggcagagatataatcttagaacaaatacttaaaatggaatttacttggaatctag

SEQ ID NO: 707 - DNA, 387 bp, Homo sapiens
tgagggtagggtcagtgttcacatggaaacagtgttcacatggagacgtcagaaaagtgaatgctacagttctgcagctctggggaggggtcttggttggggacaaacatcattgagctttcccataaaaatagggatttcaaatcatggaaaaggatggaacgactcaaggagattactgaaagtgagaagaaacaaacaaacaaacaaaaaacccttgagaaatgtttaaataaacagataaattaaatttaaaactacaatgagatacgatctcataccagtcagaatggctattattaaaaagacaaaaaagagatgttggtgaggatgcagagaaaagagaagtctccatatggttttccattgaggttgtgctactttccc

SEQ ID NO: 708 - DNA, 388 bp, Homo sapiens
ggaggggaaaagttgatccagcactgcagcttctctagggcagcccagagaaatagcatctgtctcacgaagctctaataggtccagcatggtctagacacctagggaagaacagagacagcagattgggctgatacatgctatagttccctaccccccagctcatcacagagcaagcagacaaagccacagctgccagcatctccctggggagggaaagagttggtagaggcctgctgaatctctggccagctgatttgtgggggtcttctcttgtatgacactaatctgtgaagactgggagaggtgcctgctttctctaatgtacggacgtgagcacaaagtcaaggaaaaatgaagaaccagctaaagatgttccatacaaaga

SEQ ID NO: 709 - DNA, 476 bp, Homo sapiens
gtaaagtgcttagagcagtattttgcacataacaagtggcatataataatttgttgaatgaataaacttgtcagagggggaactctcctcccccactcccaactctcccttctgtgtggagggatatcaattagtgtaacgttctgtctggaggagatggaatcattcatttgattggagagtatataggttagaataggacccagccttaagggacaggaaactccaaataatagtgacttaaacaagataaaggtcttctctagccaggcacagtggctcacacttgtaatcccagcactttgggaggccaaggtggatcacttgagatgaggagttcaagaacaacctggccaacactatgaaaccccatctctactaaaaatacaaaaattagccaggtgtggtggcgaacatctgtaatcccaggtacttgggaggctgaggcaggagaatcactttaatctgggaggtgg

SEQ ID NO: 710 - DNA, 548 bp, Homo sapiens
acccaggctggagtgcagtgttgcgatcacagctcactgcagcctcaaactcctgggctccaggagacctcctgcctcagcctcctgaatagctgggactacagtcgcgcaccaccacgcctggctaattttttatttttgtagaaatggggtattgctttgttgcccgtgctggcttcagccttctggtttcaagcagtcctcctgcctcagcttcccaaagtgctgggattacaggtgtgagccactgtgcccaacccagaaatacaccctttctgtgctgttttctcagcagggtgtgagctcacgggatacggtcctgccagactggccctcatagctggtcatgtgccagtcagagctgggtggggcttgcaggtcccggaaggtggtggtcttgacctggcagcagatgcttaaagaatgcctaaggtgggtggcagttggggagttcaagggtgaatgaggccagggcagcccccaggagctgaggccaactctttgagtcaggactgtgccgtgtgcccagggccttgcatgtgtgggcc

SEQ ID NO: 711 - DNA, 283 bp, Homo sapiens
ctattgcttctacgctaaagacttgtgcagcatgttactgtactgaatacggcaggcaattgtaatacaatggctacagcttgcatcagaccagcaatgagcttgtgtgctgaaacaacaaatctgaaacacgattatgactgccatcaccttgcagttaaccaatagtaatggaattcctttctggatcacgaggtcaagagttcaagactagcctgaccaacatgagtttcacacttgtcgcccagactggagtgcaatggcacaatggcacgatctcagg

SEQ ID NO: 712 - DNA, 399 bp, Homo sapiens
ggaaatttgcagtgtgaaccttgttgaagtcaaataaaatatagagacaaatctctaatgttttatttgggaagcaagaattgcaatttgagttatacacacagactgggtggtctttggtatgtccaaagaacaaacagaaggttaggagttttattagaaaaagaaatagtatgtattgctttgaaagaaagctcattgacacaagtcaagtttttgggagctgggaatctctgattggtgagacagtggtaggttaaagtagtcttagagtcacagcaggtcgtttcagcagctgggcttgtggaaaatctaattcttggagcaggtgctgtatgccctgggtgttctttcccctggccctgatttcgttggacatgacaagaatgacccaattta

SEQ ID NO: 713 - DNA, 674 bp, Homo sapiens
agttgtgtacttgtattgactcctcacaacaactccccttggctagtactactattacgttcactttaaggatgaggaaactaaggtaaagagaggttagatgacttgggcaagctcatgcagtgaataagtggtggagccatggtattcacccagggtgtctgagtttagagctggaagttttaaccacatcccatgttaagataattataatatacactttatcacttaacttacccatttaaactaatctgtgaatacattcttataagaaattgaagttttctgggtaaagctaatatgatacctgtttggtattaatccttccaagtctttctctatatggttacaataacatatgaacatcataaacatatctcgtatgtttgtggcatttttttaaaagttttatttttggttcaggagtacatgtgatggtttgttacagaggtgaatgcgtgtcatgggggggttgttgcacagattaattcatcacccaggtattaagcccggtacccaatagttatctcttctcctcctctccctcctcccagcctccaccctctagtggactccagtgtctgttgtttccttctttgtgtttgtaagttctcatcatttaactcccacttataagtgagaacatttggcatttgattttctgttcctgtgct

SEQ ID NO: 714 - DNA, 311 bp, Homo sapiens
cttaaggaggtatttgttgatacaaatatctctaaataaatgcatacacagaagtatcaaagctcatttctctattgcctgagataacctccagaatgcatgcaagtacatgaatatccataaatactgaactacccaaaataaacactgtattaagtcccttaagatggctataacaccctaattcctcctcaaagaacttcattctcctactgaaacaatttttctgaagcatccaggaagaaaaacagaagtgggaatgtagcatagtagttaaatagacttaggggtcaaaagcttgggtttgtatc

SEQ ID NO: 715 - DNA, 633 bp, Homo sapiens
ttctcaggaggctgaggcaggaggatcacttgagcccagaagttggaggctgcagtgagctgtgattgtgccactgcactccagtctgggcaacagagtgagaccctatctcaaaaaagcaggtgggagtaatccatggcaataaattgggatagaagttattcctggaggtggtgatgactggtatgggacacaaggaagccacctggggctgggaatgttctagttcttgatctgggagatggtcatgcagtcgtaggcctgtgtaagacttcctcgagctgtccacataagatttgtgcactttagctgaatgtggtggcttacacctggaatcctagcactttgagaggctgaggtgggcagattgctagaagccaggagttcgagaccagcctgagcaacatagtgagccccctgactctaaaaaaaaaatttttttttttaattatctgagcatgctggcatgcacctgtagtcccagctacttaggaggccgaggtggaaagattgcttgggcccaggagattgaggctgcagtgagctatgatcacaccacttcactccagcctgggcaacggagcgagaccctatctcaaaaaaataaataaaatatttgtgcagttctctgta

SEQ ID NO: 716 - DNA, 423 bp, Homo sapiens
cgccattgcactccagcctgggccacagagtgagactccgtctcaaaaaaaaaaaaaaaaaaaaaacatgtgcaagaacattcagatcagccttcttcataacagacccaaacaggaaacaacagacgttcatccacaggctagtgaagaggcaggttgtgaggcctccgcccacaccgtagaatgctattcagcaacatgggtgactcccctgcatgtaacattggcaaagaagccaggcacaagcaaatatacactgtaggattccatttatataaagagcaaaagcaggcaggagggccgggtgggcacagtggctcacacctgtaatcccagcactttgggaggccagttgtggggggtgaatcgcttgagcccaggagtttgagaccagcttgggcaacatagcaagaccccatctta

SEQ ID NO: 717 - DNA, 436 bp, Homo sapiens
gactccgtctcaaaaaaaaaaaaaaaaaaaaaaaaaaaaaaaaaaaaaagacatgtgcaagaacattcagatcagccttcttcataacagacccaaacaggaaacaacagacgttcatccacaggctagtgaagaggcaggttgtgaggcctccgcccacaccgtagaatgctattcagcaacatgggtgactcccctgcatgtaacattggcaaagaagccaggcacaagcaaatatacactgtaggattccatttatataaagagcaaaagcaggcaggagggccgggtgggcacagtggctcacacctgtaatcccagcactttgggaggccagttgtggggggtgaatcgcttgagcccaggagtttgagaccagcttgggcaacatagcaagaccccatcttaaaaaaaatggaaaattagccgggcgtgg

SEQ ID NO: 718 - DNA, 606 bp, Homo sapiens
aggcaggttgtgaggcctccgcccacaccgtagaatgctattcagcaacatgggtgactcccctgcatgtaacattggcaaagaagccaggcacaagcaaatatacactgtaggattccatttatataaagagcaaaagcaggcaggagggccgggtgggcacagtggctcacacctgtaatcccagcactttgggaggccagttgtggggggtgaatcgcttgagcccaggagtttgagaccagcttgggcaacatagcaagaccccatcttaaaaaaaatggaaaattagccgggcgtggtggtgcaggcctatcatcccagcttctcaggaggctgaggcaggaggatcacttgagcccagaagttggaggctgcagtgagctgtgattgtgccactgcactccagtctgggcaacagagtgagaccctatctcaaaaaagcaggtgggagtaatccatggcaataaattgggatagaagttattcctggaggtggtgatgactggtatgggacacaaggaagccacctggggctgggaatgttctagttcttgatctgggagatggtcatgcagtcgtaggcctgtgtaagacttcctcgag

SEQ ID NO: 719 - DNA, 409 bp, Homo sapiens
caattagcgtgcattttaaactctcagtttgtatattagcatggtattaaaatctctatagatcagcctaagaataatttttcagagaatgatttttcctgaggtgtgcatacgagtggcaaggctacactttgctttgatttcactgcacacaaaaaaggaaagttcttctctacgctttccatacaccacatacccacatttgatttactttttaaatgactcaacaccaacaattcaatatgacttttgctatcttagaagtataacatcttgggattataactttcaaaaaataactgcacagatcaggaatgctcatgttactttccaaaccctggtaagatacttgtataaggattgggggttaaaacatgtattaaaataaatgttcctctctgcaatatta

SEQ ID NO: 720 - DNA, 447 bp, Homo sapiens
tcaatttgcattccctctgtagttttcccaggttaactgtgttactgattgctttagtgattcttaccattcatggaatagttttgaaaattaattgttaagaaactaactgcagaaatgtcttgttacatggcatttatattaaagaataaaatactactttgtataaggtataaaaagtattattattattattattttattttttttgagacagtctcactttgtcacccaggctggagtacagtggcacgatcttggctcactgcaacctctgccttttgggttcaagtgattcttatgcctcagcctcccgagtagctggggcaacatgtgcgcaccaccacacccgggtaattattgtatttttagtagagatcggatttcaccatattggccaggctggtctcaaactcctgacctggtgatctgcctgcctcaatctcc

SEQ ID NO: 721 - DNA, 151 bp, Homo sapiens
gctggatggacaaggcatataaaaattgcaggtcagtggttgaatttaaaacagttgcattaatgtctcagattcaattatacttaatttggcattaacctatctctattcataaaattattattcataacatttattggactaattctgt

SEQ ID NO: 722 - DNA, 138 bp, Homo sapiens
ttttttgtttacgctttttatgcaacctagtgcctggcatagtactgtatgtatacacctacaccaagctaggctgacactggacccaaggtggggcagtctgcaagggggctggataatggtcctcaagagtgacag

SEQ ID NO: 723 - DNA, 204 bp, Homo sapiens
tcattgtcctgaaaatagaaaataataataataaaccctatttcaaagggtttctttcatcatgattaaaatatattagtcaggataaagtgttttgtaaactcaaagttttaatagaaaatattaattaagttccaaaattaactcatatgcaatcattgcaacggctcgattagaaagggttttgtgtaaactgtagcatca

SEQ ID NO: 724 - DNA, 421 bp, Homo sapiens
actggtactcattatttcccttggcactatccattctaaattggctggctttggcttgtcacctttatgaggtcctctggcttcttggtggtaagactcaaacattcctattagagagtttagactctgataaacatacctttctcaggctatttttgctacatttctccattcatagtcacagtcacatggtaatggaataacaagaagcaccagagtgatgacctcagtcccacacgttttactccctgctctcatggtgttacagcagccctacctccatctgattaggatcaattattcatacacaaagaagactactcttcttgcttggttccccaaacacaaggaatacaaagtgtccagttggcaacactagtttgtagtgaatgtgactatgctatgtcctttagcaagagtg

SEQ ID NO: 725 - DNA, 708 bp, Homo sapiens
gaaactagtatgacctgaaagctgagaaagataaattgcttctgcttattcagtgagtacatatatgtgtatactgatttcactggaggcaccatttttccacagtgatcctttccccctcttgtggtttgtctagccaggggttctggggcctcgggaggccctcatgttcatttcttccacggcccatactgcctcctccctttctccacacacacagcccttaacaggtatttatttcaaattaccaaagtgagttgctctcacataagaaaatgcaaatatcccgtgcacttaccaaacttgattctagtatagtagaaggtgcttaaagggtttgggccctctctgccgtgctctccctcatggcatcagggcaatacagcctaccaaacactccatgtgagggtttggggagccacctctgcccagtccctacgttgttttcccatcccatgcagaaaaaaaaaaaaaaaaaacttcaggggggggccccgtaccaaaattcgccctaatatggaggcgtattacaaatcacatggccgccgttttaaaaacgtctggactgggaaaaacccctgcggttccccaaattaaatggccttggaaaacataccccttttgcccaacttggcttaaaaaccaaaaggcccccaaccaatgcccctttccaaaaattgcccacctctgaaagccaaaagtgaaatt

SEQ ID NO: 726 - DNA, 484 bp, Homo sapiens
aaattaacaacatgagcaacaacatttaagtgacatttctagaacattccatccaacagcagcagaatacacatttttttttcaagtgcacatggaacatttaccaagatagaccatatcctgggacataaaacaaactttaacaaatttaaaataattgaagttatgtgaagtatgttttctgatcagttgtgatggaattaaactgtatgcctctcactcattcttaaaatgcaaggctggttttatactgaattaataattagtaaccttccaaaaaaagaaagtacaagacccagatggtttcactggtttcactggtgaaaccaaatgtttaaggaataaatagtatcaattctctgcaatttcttccagaaaacggaagcagagggaatacttcttaactcatcctatgaggccagcactaccctaataccgaaacgagattaagatattataataaaggaaaattaaaaaccaatct

SEQ ID NO: 727 - DNA, 639 bp, Homo sapiens
ttggaacaaccttactcatgcattataatttgcttagcaatcctttgttcataggcagtgcaaagattagttacagccctcctactgtctgaattactgtactttctgaattagtagagttggcattgataatcttaaaaatataaacagtaaataaagcatttaaaaccccccatgctgctgacttcatataaagagatagttgtttttgaatattttgatgtccgtacacatttttctacagaggcagtatttaaatgggtttgtataaataagttctctttcttgaagcttgtgcaaagcatctttacacaagaagcttataagcacagtcaataaattcaagaaaatggcccttttgaaaggaagccactgatgcatctgtgggctgacttctgcatgaatgacagcgcagtaataagaaagcagacaacggcttcctccgccaccactgccctgccgtgctcacgctgcatgggggtgccctcgcagcgggagtgtgtgtttgtcctggtggccggggactgcggcttggcctttttgtttacaagagagaggacagcagcctctgccctccagctgctgtgaaaacagtgttggaaaaccagagcgaagtttccactgaagaactcacactgg

SEQ ID NO: 728 - DNA, 410 bp, Homo sapiens
tacaaaaaaaaaaaaaaagctacattgctcaaagaaaaacaggtcgacatcatcatactgtaacagctatgctctgtgccagaagacagtggaatgacatatttcagatactgtggaacagaattttatcatcaccaagccagcttttaactattaaagctgcagacaaacttctcaaacataggggaacacaaggaatactgttcccataagctcttcctgaggaatttattagagaaaatgaattccagatgacccaaataactggaaagtccatatcaacataaaaatggtagtgggcattaaatatatatttatctgtaaaaacctgaatgagggttctaagtgacactttatactacataatgactatatgttccaacattgtagctagagcacaactatccata

SEQ ID NO: 729 - DNA, 413 bp, Homo sapiens
tattttgttaaatgttttcctctgccttttgtccttttcttcagaaagtgtctagtcagctgttaatcttatttagtgtagttttaatttcagacattgtatttttcatctccagtaaagtttgattttggtcttttaaaaaaaatctggccgggcgcagtggctcatgcctgtaatcccagcactttgggaggctgaggcgggcggatcacgaggtcaggagatcgagaccatcctggctaacacagtgaaaccccatctctactaaaaatacaaaaaattagccgggcgcggtggcgggtgcctgtagtcccagctacttgggaggctgaggcaggagaatggcgtgaacccgggaggcagagcttgcagtgagccgagatagcgccactgaactctggcctgggcgaaag

SEQ ID NO: 730 - DNA, 421 bp, Homo sapiens
tccaaaaacgttagtaataaatcgcttattaaaaaaagtaaaaattcagatcaaagtgtctagtcagctgttaatcttatttagtgtagttttaatttcagacattgtatttttcatctccagtaaagtttgattttggtcttttaaaaaaaatctggccgggcgcagtggctcatgcctgtaatcccagcactttgggaggctgaggcgggcggatcacgaggtcaggagatcgagaccatcctggctaacacagtgaaaccccatctctactaaaaatacaaaaaattagccgggcgcggtggcgggtgcctgtagtcccagctacttgggaggctgaggcaggagaatggcgtgaacccgggaggcagagcttgcagtgagccgagatagcgccactgaactctggcctgggcgaaag

SEQ ID NO: 731 - DNA, 473 bp, Homo sapiens
ctgccttggatttctggggattcacttcaggccctattcatccggtttgctcccatgcttggagatgtcacttgagaaggctggagaatagcaaaggcaataggaaggcccaagaagaggaagaaagattgaggaaatggccagtttgtgcagcagtcagaacatacgcatttactgattaagcttgctgttatatatggatgcagtttgtggcacctcaaaataattacaaaagcaacattaaagatcactgatcacaaatcaccataacatatataataagaatggaaaagtttggtatattgcaaacatgaccaaactgtgacacagagacacaaagtgagtgcacggtgtttaaaaaaatggtgcaatagacttactcaacacagggttgccacatatcttcaatatgtaaaaaatgcaaagtctgcaaagtgcaataaagaaaagcataatacaatgaagtatgccta

SEQ ID NO: 732 - DNA, 519 bp, Homo sapiens
agagaaataaaggacactgctgtcattctaactaaattgtccagaggaggaaagaagagtacaaaaatgattatgaatacttaagaagaggcatgactttgtcattggtgtggagcctataattatgtgcaattccctacttaagactttttagttatgctgaacattgaaaaaaaactaaacagcggagaggagaaaagaaaaggggaaatttaaacatttaatggaacacattcattaaatggagacatcgcttcaccataagggggcagttaagggtttggtagtcctactcacttgctattgtcaaatcatttgttttatcatggatttgagatccttataagtcttcattattattttgaattcaagaatgattccttctgctcacaaaacatgatcacttttcattgatttttttttttaatattctgactggttttgcatatctggaaaagataaatcttcaaaatttggaaataaatatttttcctccctgccaaatccataatatgatcc

SEQ ID NO: 733 - DNA, 519 bp, Homo sapiens
tttttttgacacggagttaagctcttgttgcccaggctggcgtgcaatggcgcaatctcagctcactgcaacctgcacctcctgggttcaagcgattcttctgcctcagcctcccaagtcgctgggattacaggcatgtgccaccacgcccagctaattctttgtatttagtagagatggggtttcaccatgttggtcaggctggtctcgaactcctgacctcagatgatctacctgccttggcctcacgcctggattacaggcatgagccaccatgcccagctagttttaagaaattataaccacaagccttccactaactcatacttgtaaatacaaatctttccaccaattatcctagacaaagttgctaaaacaattctctttctatttctcccaagttcaaatctacagtgcctttctgatgtttctatattcatgtgaaatttgtaggagaaaaagtaaaaggctgtatttaccccaaaaaagaaaaaatctcattaaagcttaaatttaaaa

SEQ ID NO: 734 - DNA, 329 bp, Homo sapiens
tgttatttttaattttatttttgattcagaagctacatgtgtaggttacacaggtatatttcatgatgctgagtataacccataattctttttttgagatggagtcttgctctgtcgcctaggctggagtgcagtggcgcgatcttggctcactgcaacctccccgtcctgggttcaagcaattctcctccctctacctcccaagaagctgggattacaggggctcaccaccatgcccggctaatattttttgtatttttagtagagacggggtttcatcatgttggccaggctgttcttgaactcctgacctcaagtaatccacctgc

SEQ ID NO: 735 - DNA, 484 bp, Homo sapiens
atgactatgtaagactttttaaaaaccccttatggcaaagtgcttttatgtcacttggccagtgtgagaaagcaaatccacaaaccataggcccatttgattaggaaatttcagaatgtcacttacagcttcaggagatagtagctcaatctaaaacaaaactgttgacagaattttgaaagttgtgtaatcgtatttataatctctgtctcaaagagagatccaaacaaaagaaaccaccatgtcataattaatgacaagatatactgaccaatggcaaggctgtcccttcttttgaaggctcaaacgatttgaagagtttgaatacagataccttaaatccacttagacagggacatattgttatcccctttcccttggtcagctaattcagcaagaacattctgtagtgtgtgctcctgtagttttaagactgaaccttaaaagtgaaagcaagacaatatactgtggatgaaatttgcca

SEQ ID NO: 736 - DNA, 1704 bp, Homo sapiens
cgcggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccgtggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacacccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaaaacttt

SEQ ID NO: 737 - DNA, 619 bp, Homo sapiens
cgcggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccagagtttaccttccagcagccctacgaccaggcccacctgctggcagccatcccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaaaacttt

SEQ ID NO: 738 - DNA, 1646 bp, Homo sapiens
  misc_feature (1557)..(1557): n is a, c, g, or t
  misc_feature (1559)..(1560): n is a, c, g, or t
  misc_feature (1569)..(1569): n is a, c, g, or t
  misc_feature (1590)..(1591): n is a, c, g, or t
  misc_feature (1593)..(1593): n is a, c, g, or t
  misc_feature (1612)..(1612): n is a, c, g, or t
  misc_feature (1620)..(1620): n is a, c, g, or t
  misc_feature (1622)..(1622): n is a, c, g, or t
  misc_feature (1637)..(1637): n is a, c, g, or t
cgcggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccgtggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacacccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacccgncnnccccccccngcccgcacccccccccccccnnanccacaccggtatccacacnccaaacancncgtaccaaggaaacnaaaaatata

SEQ ID NO: 739 - DNA, 368 bp, Homo sapiens
gacttttcctgtgtattgctgacacatggtagccactcaatacattttttaaaaaatgaacagttagatgccaagcaaaggaacatgaatgttattatacagctaatgaagaatcactataggattataatgaagagaatgacaataacagacctgcatcttagaaattagttacagaagcaatgcagtggaaaatggatttctgtgagatgttactaaaagcaagaaagccagttatcaaatagcaatagtccaggctgggtgtggtggctcacgtctgtaatcccagcactttgggaggccaaggtgggaggattgtttgagctcaagagttcaagaccagacagagcaacatagtgagaacttgt

SEQ ID NO: 740 - DNA, 487 bp, Homo sapiens
caggctggtctggaactcctggcctcaggtgatccacccgccttggcctcccaaagtgctgagattacaggcgtgagccaccccgcgcacagcctagactctaattttataaaactttgttgaattttctaagtgtcatttaggacatattgtgcttttctgtggagcttatatcttatcctcttatgtgcaacaaaaagggggtcggaggtaaatgctgatgatgttgtttagttttatttccttttgatctggcatgagtaaattgctctgtttccttaagcttgggtctgttacagagctttgtgccttatagggtgctcagtgtgtgttgacaaagggaataagaactgtcagtgccataaagaaccaaagattctggctactttgtcttcttcctttctctcccactatgcctacacttcctctgcccagacacttttggaaagtgtttaactgctgggcaatagagcgagactctgtctca

SEQ ID NO: 741 - DNA, 503 bp, Homo sapiens
gcaagcgctgtccgcgttagccagcatgttcttgatctgacctcgtgatccacccgccttggcctcccaaagtgctgagattacaggcgtgagccaccccgcgcacagcctagactctaattttataaaactttgttgaattttctaagtgtcatttaggacatattgtgcttttctgtggagcttatatcttatcctcttatgtgcaacaaaaagggggtcggaggtaaatgctgatgatgttgtttagttttatttccttttgatctggcatgagtaaattgctctgtttccttaagcttgggtctgttacagagctttgtgccttatagggtgctcagtgtgtgttgacaaagggaataagaactgtcagtgccataaagaaccaaagattctggctactttgtcttcttcctttctctcccactatgcctacacttcctctgcccagacacttttggaaagtgtttaactgctgggcaatagagcgagactctgtctca

SEQ ID NO: 742 - DNA, 338 bp, Homo sapiens
accaggtgacctcagggacaaaggcatttcttttgctaatttaatcagtaatagtttcaaaggcttttaaacctcaggttcctacacaaacagctcctgccaggtagataacagagggagcctgttctcttttgaatacttagccatgaattacaagcatcagttggacagaagagattgaattcctataggtactatccagatcataaaaaggtattaaggcttgccctctattcctgctccatcagcatgaagagaggtttctaagagtcttaactcacaaaaaaagcaattcaccattttgttcaaagcaaaatcataaccataaattgctctta

SEQ ID NO: 743 - DNA, 367 bp, Homo sapiens
gaggatcacatcactgggctcctttgagatccatatgcctcaattcaaccctgtcaaccatgccaagaaagaagagagcagcttatgtccaaagaaactgggaaagaaaaaacaaatctccatgatgctttctttagatgacactaagcaactgaatgggggattaaaaaacaaaaacaaacaaaaaaacaaaacaataaaaacaccaccacagtaaacaaacagaaaaaaccaaacacacattgacctcatctctgggtcttttgtaactgaagaaacaacacctgagttacatggaacaaacactttatcttagtcttcttcaccttcactgtcctatttttgaaccctagacaccacacctgcc

SEQ ID NO: 744 - DNA, 412 bp, Homo sapiens
ctcaattttgtgtaaagttatgacattaagatctttaggcatcatttattaggaacccaattgccttgagaaatttttctttcgttgggagacttactcatcatttagtaaatatagaatcacaacttcaaaggccagctctggaataattaagaatctttctgggcagatttaaggtctgcatctgaatagctgtatatacagaaagcctaaaggatcaaaatagtccagaacatttcaggactggacagctggtgagtaggtaaaggttgcctgtgcctcactctgtcagtcaatttaatgaatatcaaaatcactcatacaccaaattgagaagccaaggatctcatcttgactgagaatcggcaccttccagaacctgacttagttttgcaagagcagttttagtagc

SEQ ID NO: 745 - DNA, 387 bp, Homo sapiens
taaaatatttgttttatttggaatccatgtatttgtaattttagtgtttgtattaatacaagggagaaatgtttaaatctgtctatgccatatgtgcctctggcttattgcccaattaattgtagcctcaggctaaactttggtttctgtctttaatttttgtcagaagaaatataactgatctcaaaacatctgcttttattgtaggggctcgtgctgccatctccattcctctctcttttcttgcaatctgggtggaagttctttaatatgaacatttcaaccaccttcattctaccatgtccactatcagcacattcaaacttatccagccaaggctgtcatcttaggccagggattttttaggaatctattatgctgtgatgc

SEQ ID NO: 746 - DNA, 342 bp, Homo sapiens
ccagctgatatataacccaaaccccagacttttctcctattccactgccaaatgggaacctttccttgcctttcctctggttcccagctccacccctccaccctggctctctacagccagttctcctcccagcagacatgggatcttttgcaaaggtaaatcagtccctccctgcccttgaccctgcaaatgttcgtagtcttgtttgctggaccatgggttattggagcgtaaaacttcaccatatctttatacccatccatcaccccacagcactgagtcaagtgcttccacatcataggcacttggtaaattatttttgaataaattattggaaaaagg

SEQ ID NO: 747 - DNA, 405 bp, Homo sapiens
ttttggatgaagatgattcttcttttcctaactctgaggttgccctctttcatgtgcattcacattaactgtcagccatacctgtgtacctcaacactcactggttgctgcctgtaatactcttacaaaagatttaatgaagtgatggagaccttgggtgtctagcaactgccattgtttgtcaggggaatgtgagatatatgtgtgggaaggtccctgagttcctcttggacttatcaaaatatcacaaaattccagtacaaagtatctttccacagattcagctgtgctgtgggtcactaatacttgggtcattttaagctgtggtgcagaaacctacagcagaggtgtgaatcttcttccctttggcaactttatgtcagttctgatacattaaaaaaaaaa

SEQ ID NO: 748 - DNA, 384 bp, Homo sapiens
caggaagagattttataaacaaagccaaaacacagaaatcatacaatgaggtggtgggaatgagactaactgtgcctgtcatctccaatgtaacactaactgctgtgaattataatggatttaagtctctcagattggatagaaaaggaaatgccagctctaatggtttaatgggcagaaaagggttaaatattcaaagcagtgcacattatattatatatatatatatatacgtatatattgtataggagggagatatacatatatatacattttttttttgagacgcagtctagctctgttaccaggctggagtgcagtggcatgatttcagctcactgcaacctccacctccttggttcaagtgattcttctgcctcagcc

SEQ ID NO: 749 - DNA, 309 bp, Homo sapiens
tgacgttaacaggggggtggtgtgaagggagtttggtacatcttcagacttcaagacaggaaaaaaatgtttgggaagaggccaaataagagatacagcatggccctagctaaatggtaatgatgtaacaaagagcaatattcagcactatctagatatcagagagaacaactggatactaaaatcattataagatgtgaaattatacctctcactacttcattatcactatatttcataatatttgtctagaaaggcacacaaagtctatcaggttaaattaatcctaatgatcaatttcagttttat

SEQ ID NO: 750 - DNA, 1397 bp, Homo sapiens
tcacttccccttcctgcaccccatcctgatttgagggagcccaggatgacaaagagggagtagttgagcaaggtatggagtggcagtctctacaggagctcaaaggatgcatttgtccatctgccctgggctcagcttccacactcagagtcactcacatccctccaccgtcgccacagctcacttgtgtgcccacacagacaaggtcacactgaccccaaacgcacactgtttcaactctcagcacttcactgtcacactcgcgtgtgtacacacatgctttctaatttccacagccacatggatgctcacacactcacacctttgcacacacacacaagctggctcacagacacactgggggcccagatcctggtcattccccacaggtcttaataaaggttcatggaaggaaacctgtttcctaaggtagggtgggagtgtgtgtgagtgtgtgggggggagagggtgagagtgagtgtgtgcgtgtgttagtgtgtgtgtgtatgtaaggagcaggagtgactgggtcctgagtttagggagttgggaagaggaaggagagatggagacaagcctggaccaagagccactcagagctgcctggaagggaagccaggctgagataaaggcaaggcaaagaaataagacactgacaaggatcaagccagggttgggtagggactgggaacagagtctgcctccatgagaagctgtcacattgctgctctggtgccctgtgacagcagcaccatctccagctggagactcccctctctggatcttgtcattgtgactttgctttgttggacaaccaggagtggtgacaggcagggaatatggtgcccagggcagctagccatgccacgccagtccagctgccaacccacccgtcactggccatctcatcacctgccagagggagtggggtggtgcagatgaaaccagcgatcagcttggctgcccttgcttcgtagtgccacagtagaggctaggggagcaactggctttcctccccaaaaggcgggcagggttatccacactttgcccaggtccctgaagcctgcggctgagctcggggataacaggggccaagtcaccggtcccagacacctaggaactattagagacaggaaccagcatatgagacaggggctgttaagtaggaggttggagaacacacgtttttggtctaaaccgggggcccctctctttgcccactgagcccgcggcctgcgtggtgctgagactgcctctggccgcgtccgcttgggacaaggcctgagcggtggctgatcccacctggatgtcctgggccggctcccacccgaagcccgccatcccgggacgcggtggggagaagctggcgctgctccttgccatgcttggcggccgct

SEQ ID NO: 751 - DNA, 373 bp, Homo sapiens
aaactataaaagttccataacaccagcagatcttaatattttatggtagaactgggcattttcatgctccaccccataccatggcacattaaaaacatgcccttctgctttaagcacaatcccaccctgcttgtaaattatttttttgaccctaaatatggcacacatttaaaaagacatcattgcagtttatggatctgtgtttttttgcaaatgcaggggccattaattgcattcacagctgtggtcttccccatgctatatgcattaggctgccagtaatgcattctctgtgagagccaagaagaaaagcctcctgtgtccctcttatggagtggcttccttaagctctcaggcccaagcagcacagaaa

SEQ ID NO: 752 - DNA, 836 bp, Homo sapiens
tgagagtgatgccgaggaagacacttccctccgagtcttagtctgcccgcctgtgaaactggctcgtaacaaacccctgaccccaggctcggtcgccttgagcccaagacctcacccaatgccccccgccccgccttccctcccgggctcccaggaggtgcggggactcggggggcggccccttcctcgggaggcgcccaggtggcacgtcggtgcctcagctcccggggtctctgggctccgcgctgcccacggggtgccgaggggcctctggagggggcgggttctctcgagccagaaagtccggagccgcccaggaattttggctcgaactgagtgcatttcctctcgggccggccgggtgcgatccgggaagggcggctgcgggcagacgcggcgctgcgctcggccaggccggcaccatgcggcccctgctctgcgcgctgaccggactggccctgctccgcgccgcgggctctttggccgctgccgaacccttcagccctccgcgaggagactcagctcagagcacagcgtgtgacagacacatggctgtgcaacgccgtctagatgtcatggaggagatggtagagaagaccgtggatcacctggggacagaggtgaaaggcctgctgggcctgctggaggagctggcctggaacctgcccccgggacccttcagccccgctcccgaccttctcggagatggcttctgagccctggagctggagcccagcagttggaggtggtgcacctgccaggcagcgcccacagaaccagccctgtcctctcgacttccttccttagcttcatgtgaaataaaagctattctggtc

SEQ ID NO: 753 - DNA, 1067 bp, Homo sapiens
ttttttttgaggcagagtctcactctgtcacccaggctggagtgcaatggtgtgatctcggctcactgcaacctccacctcccggttcaagtgattctcttgcctcagcctcccgagtagctgagactacagacgcgcaccaccatgcccggcttctttttgtatttttagtagagacagggtttcgccacgttggctaggctgatcttgaactcctgacctccgatgatctgccccccttggcctcccaaagtgctgggattacaggcgtgagccaccacgcccggcctaatacttgaataatattttaatgcaattggtgcccttagtaattctatatgttttattttttgcatttaaggcattattctgagaagaggtctgtaggcttcaccacactgccaatggggtccatggcatacacagggaaaaaccattaagaactcagtaaatttcagaatcccaaacctgtcatttggcagagataccaccagggggcggaacaacaaaaggaatgtgagctccaggctgcaaagtccaaaagggagaaggtattctacaggcgcttcatccaaatctgtgactaagtgccaaaaaagaaggagccttagagagcaagccccctaggatattgtcatctggggaaactgaggcaggtaggggcagagcctgagtgaggaaaacccaggtcacttagcgcccagtcctttcccactgcaccgcactggaccgccagctgctctcttaggacctagctgatgaagcggaacgtggaaccacttctgtcctcgactttaccccacttcccactctagatggtagagaagaccgtggatcacctggggacagaggtgaaaggcctgctgggcctgctggaggagctggcctggaacctgcccccgggacccttcagccccgctcccgaccttctcggagatggcttctgagccctggagctggagcccagcagttggaggtggtgcacctgccaggcagcgcccacagaaccagccctgtcctctcgacttccttccttagcttcatgtgaaataaaagctattctggtc

SEQ ID NO: 754 - DNA, 1172 bp, Homo sapiens
tgagagtgatgccgaggaagacacttccctccgagtcttagtctgcccgcctgtgaaactggctcgtaacaaacccctgaccccaggctcggtcgccttgagcccaagacctcacccaatgccccccgccccgccttccctcccgggctcccaggaggtgcggggactcggggggcggccccttcctcgggaggcgcccaggtggcacgtcggtgcctcagctcccggggtctctgggctccgcgctgcccacggggtgccgaggggcctctggagggggcgggttctctcgagccagaaagtccggagccgcccaggaattttggctcgaactgagtgcatttcctctcgggccggccgggtgcgatccgggaagggcggctgcgggcagacgcggcgctgcgctcggccaggccggcaccatgcggcccctgctctgcgcgctgaccggactggccctgctccgcgccgcgggctctttggccgctgccgaacccttcagccctccgcgaggagactcagctcagagcacagcgtgtgacagacacatggctgtgcaacgccgtctagatgtcatggaggagatggtagagaagaccgtggatcacctggggacagaggtgaaaggcctgctgggcctgctggaggagctggcctggaacctgcccccgggacccttcagccccgctcccgaccttctcggagatggcttctgagccctggagctggagcccagcagttggaggtggtgcacctgccaggcagcgcccacagaaccagccctgtcctctcgacttccttccttagcttcatgtgaaataaaagctattctggtctcctctgtgtctgctgacagagtaacccgtttaactacagcctcctctcactccacttccatgcctggaggaagcctgcaaccccctccaggctcagacctggggacacccccactcctgtcatttataggggcagatggagcaggggttgattcacacagatgggggccctttgagtggccttgcttctcaaaatgtggccataggtgaaaagcaaggggatcagggtctcaggacccacccagactgtttaatccaaatctgcattgcaatgagacccccagggattttatgtgtccattaaagtggtttgttgttgtttttaaaaaaaaatcc

SEQ ID NO: 755 - DNA, 1403 bp, Homo sapiens
ttttttttgaggcagagtctcactctgtcacccaggctggagtgcaatggtgtgatctcggctcactgcaacctccacctcccggttcaagtgattctcttgcctcagcctcccgagtagctgagactacagacgcgcaccaccatgcccggcttctttttgtatttttagtagagacagggtttcgccacgttggctaggctgatcttgaactcctgacctccgatgatctgccccccttggcctcccaaagtgctgggattacaggcgtgagccaccacgcccggcctaatacttgaataatattttaatgcaattggtgcccttagtaattctatatgttttattttttgcatttaaggcattattctgagaagaggtctgtaggcttcaccacactgccaatggggtccatggcatacacagggaaaaaccattaagaactcagtaaatttcagaatcccaaacctgtcatttggcagagataccaccagggggcggaacaacaaaaggaatgtgagctccaggctgcaaagtccaaaagggagaaggtattctacaggcgcttcatccaaatctgtgactaagtgccaaaaaagaaggagccttagagagcaagccccctaggatattgtcatctggggaaactgaggcaggtaggggcagagcctgagtgaggaaaacccaggtcacttagcgcccagtcctttcccactgcaccgcactggaccgccagctgctctcttaggacctagctgatgaagcggaacgtggaaccacttctgtcctcgactttaccccacttcccactctagatggtagagaagaccgtggatcacctggggacagaggtgaaaggcctgctgggcctgctggaggagctggcctggaacctgcccccgggacccttcagccccgctcccgaccttctcggagatggcttctgagccctggagctggagcccagcagttggaggtggtgcacctgccaggcagcgcccacagaaccagccctgtcctctcgacttccttccttagcttcatgtgaaataaaagctattctggtctcctctgtgtctgctgacagagtaacccgtttaactacagcctcctctcactccacttccatgcctggaggaagcctgcaaccccctccaggctcagacctggggacacccccactcctgtcatttataggggcagatggagcaggggttgattcacacagatgggggccctttgagtggccttgcttctcaaaatgtggccataggtgaaaagcaaggggatcagggtctcaggacccacccagactgtttaatccaaatctgcattgcaatgagacccccagggattttatgtgtccattaaagtggtttgttgttgtttttaaaaaaaaatcc

SEQ ID NO: 756 - DNA, 715 bp, Homo sapiens
tgagagtgatgccgaggaagacacttccctccgagtcttagtctgcccgcctgtgaaactggctcgtaacaaacccctgaccccaggctcggtcgccttgagcccaagacctcacccaatgccccccgccccgccttccctcccgggctcccaggaggtgcggggactcggggggcggccccttcctcgggaggcgcccaggtggcacgtcggtgcctcagctcccggggtctctgggctccgcgctgcccacggggtgccgaggggcctctggagggggcgggttctctcgagccagaaagtccggagccgcccaggaattttggctcgaactgagtgcatttcctctcgggccggccgggtgcgatccgggaagggcggctgcgggcagacgcggcgctgcgctcggccaggccggcaccatgcggcccctgctctgcgcgctgaccggactggccctgctccgcgccgcgggctctttggccgctgccgaacccttcagccctccgcgaggagactcagctcagagcacagcgtgtgacagacacatggctgtgcaacgccgtctagatgtcatggaggagatggcttctgagccctggagctggagcccagcagttggaggtggtgcacctgccaggcagcgcccacagaaccagccctgtcctctcgacttccttccttagcttcatgtgaaataaaagctattctggtc

SEQ ID NO: 757 - DNA, 369 bp, Homo sapiens
atgaaagagagagtcatcttttaaacacagccaataatggtgactccggaaaggcagaaaaggaatctctgaagtaggtgtcctggagtcagttgttgaaacaatcctattgacaagtactgtgatagacagaacaagatacatacgccaacaggcatatgaaaaagtgttcaacatcactaattgtgagagaaatgcaaatcaaaaccatctcacaccagtcagaatgactattttggggaaatagccattggggaaatcgtggctctagatttttttttctggaagaattttcgtttgatgcagggggtatcttttgtccttggtagaaagtttcccaagagcctttgaatctgcagttactgactt

SEQ ID NO: 758 - DNA, 424 bp, Homo sapiens
gccccagccggcacacagaggctgctcctgggcctctccgagccctgtccacccaggcctgcagcagcgtctgcccagatgggctctactccctctgccgtcctgccggtccccagccacccatctccgggaggcggcttgctttcccgatttgcaggcgtgctttcttttggcagggagctgctgccgtctgtgctctggaccgtaaaacaagttttcatcaataaattaagataagcggaaagccagctccagaggaggtgggttgaggcgggctggcgggcgggaagctgttctgtgacccagaaggggccgaggcaaatccaaagcaagactgggtccccacccccttccccgggtcccctgtgccccattcgacccaggcctctcagacagggggaggattgggaggtcacctgcctcc

SEQ ID NO: 759 - DNA, 346 bp, Homo sapiens
catacagcgcatgtgagctgctgctcttttccaagtgttgccctgatggtatctttgataacaaaacaatacacataatgttgaattcatccagctttattatcctgggaaaggagggaaagaagcatctaagggaaacaaaacattctgggctggtaaatatcctgtgctaatctttaaggctgcagaaaagattgttcatgtatctcttatttatgcttagattctcctgagtgctgctgttcttttatttttcttaaagcaaggatctcctctatcatgctcattgaggaagcatgttatatcagtgttatatacaaacatcccttgatttagaggcacatgg

SEQ ID NO: 760 - DNA, 305 bp, Homo sapiens
gcttagccttctctgaaaacatacatttgcacactaagccagattcacatgggaggtacattatgccgtggcctagtctagtgtgtatttcccctttctctccccacaaagattttacaaaacttatacatgcaaacaggtatttttgtttgtttcacatgagtcgcttttgcataatataacaagcccatgatttcacatgtacagtaattcatagaaagtgatagtcatcttgcttagacaccttagttctcaaatctagcctgctaaatatagtaccttctcagacccatataaggtgtcat

SEQ ID NO: 761 - DNA, 404 bp, Homo sapiens
tgaaggcagcagcctgtttgatcatccctttcaatcatatttgtatctcagaccgtgcacagtggcttattcctgttatcccagcattttgggtggccgacctggcaaatcacttgaactagagttccagactgcctctctttaaaaaaaaaaaaaaaaaaaaaattagctgggcgtggtcactagttcctgctgtttcacctactcattctggagtgtgtggtaggagaattgcttgcgcttcagaggtggaagttgcagtaagcagagatggcgccactgccctcacacctggccaacagagtgagaccctgtctcaaaattagtaacaatcatcaccatcatatttggagctctgaggtccacgcatgctcaggcattgttctggtgcttcctggttgaga

SEQ ID NO: 762 - DNA, 526 bp, Homo sapiens
aatctgtatgaatgggcatacttgtgttccaataaaactttatttacaaaaacaggtggtagccagatttgggccacaagccataggttatggactcctgatatatggtttgtaaatacagtgaccatattcatacagctaaaaatgttcaggccagaatatgggtgcaggcagtccaaggtgtgtgactgccaagcacaccggcctatcattcattcacacatttagaaggtttctgccaaacatcactgaagtgatggacactgtgccaggcaatgaggggatgtgagagtcaaaggaattcgggcccagcctttgaggggttcacagttcatcggcattcaggctgttcaaatatacgcttaattgttcatcagcccatacaacctggggtcctgctttggaactctgtgtgtgtatgacacacatatacctaatatgtatgtataatgtatatgacagcatctcttggaaacatgaaaaaggtctcattctcccagcagcagaaataaaaagccatcacaga

SEQ ID NO: 763 - DNA, 407 bp, Homo sapiens
caaactactgatagatacaatacttaagttaatgatgacaggcacaaagactacatcactgtgtgattccacatttatgaaatgtggaaaaaccaaagctataacttacagaaatccagtcagtgggttgccaaggagtaatggaggagactgactccaatagggacacaaagaaacttttgggagtcatagaaatgtgtgtattagaattgtgtttgtgcttattggaatattgtgcaactggaatattggtgtattttatatatgtaaatgagtctttcataaaaataagttttttttcaaagcaaaagcaaactaacttagcaaactgggaatagagaagaatttccccagccaaagctgttacttaaaaaagaaagaagagggaaggatgggaaaaagaagac

SEQ ID NO: 764 - DNA, 395 bp, Homo sapiens
gtatatgctccctggttttcaggatctgaaggttctaaagttacttgaagttaaaggcagccttacttattgaacaccaagcactgtgcagaaatctttatatgtggtgtcatttaacccttttaatatttctactgatttactcatgtttcattgcccttttacagttgagagattaacacgtccaaagtcactcagacaattattaacctgctagattaatgcagatctgggattcccatccaggtgtgtcaagaccgtagagctcctgctgtttactaatcactggattctaaaggtgggagccactttctgagcatatttgctgcagacttggttccataactaaaaaggtgcctggatcatgtgacgagaattcaggaaagaacccaacc

SEQ ID NO: 765 - DNA, 305 bp, Homo sapiens
ctctcctacatgcaaaataagatgatgaatgttctccaaatgacagaggaggggaaggcctcaatgctgtgaactctgtagggtttcagctcagattggaccttccagactggcctggaaagccatgggggccagggtgtctcagcattggcccgcttttggcctggtatttgttgaacatctatcagtgggtctttttcttgtgtctgtcttacagcatttctctcatctacccctagtttagaaatgttttcttagataacttaaaattcatgtaaaataagaggtgatggatatataagttt

SEQ ID NO: 766 - DNA, 459 bp, Homo sapiens
ggttgcctgttcactgtgatgatagtttcttttgctgttcagaagctctttagtttaattagatccaatttgtcaattttggcttttgttgccattgcttttggtgctttagacatgaagtctttgcccatgcaatgtcctgaatggtattgcccattttctttttttgttttccaggggataaaatgtcttccttagaaacaaagtgtgtggttcaagtctcaacatatatcttcagttcctagccaagtaaatgatattcaataaattctataaatgctgactgattgaatgaatgattaaatctttatattaacttccatatttatctgtcttttgaagtcattgcactttagctctctttttttgtgtgtttttgactttgaagttccgggatacatatgcagaatgtgcaggtttgttacataggtatacctgtgccatggtggcttgctgcac

SEQ ID NO: 767 - DNA, 601 bp, Homo sapiens
  misc_feature (551)..(551): n is a, c, g, or t
aggcgacggtggggaagatggcgtaccagagcttgcggctggagtacctgcagatcccaccggtcagccgcgcctacaccactgcctgcgtcctcaccaccgccgccgtgcagttggaattgatcacaccttttcagttgtacttcaatcctgaattaatctttaaacactttcaaatatggagattaatcaccaacttcttattttttgggccagttggattcaattttttatttaacatgatttttctatatcgttactgtcgaatgctagaagaaggctctttccgaggtcggacagcagactttgtatttatgttcctttttggtggattcttaatgacccagtcggacaggatgagcaagtcaaaggaacttttaacccaggtattgcagttggacacatatattttttcttggaagatgtatttcccaatcaacctggtggaataagaattctgaaaacaccatctattttgaagctatttttgatcaacagatgaggatccaaatacaatcactacctgaggaacggccagaagcttcgctggngtgaggcccagcgcttggaggtagcacagtgccattatgagacccagctg

SEQ ID NO: 768 - DNA, 347 bp, Homo sapiens
  misc_feature (297)..(297): n is a, c, g, or t
gtggagccgaaggaacccctatgtccgcatgaacttccttcggccttctcaacttccaggccccctttctgccctgggtgctcatgggattttccttgttgttggggaactcaatcattgtggaccttttgggtattgcagttggacacatatattttttcttggaagatgtatttcccaatcaacctggtggaataagaattctgaaaacaccatctattttgaagctatttttgatcaacagatgaggatccaaatacaatcactacctgaggaacggccagaagcttcgctggngtgaggcccagcgcttggaggtagcacagtgccattatgagacccagctg

SEQ ID NO: 769 - DNA, 505 bp, Homo sapiens
  misc_feature (305)..(305): n is a, c, g, or t
acaggaaatgtgatcacttgaatgtgtgatattcattcatccactcattcattttgctgaccattaattaattcaattaaccctcctgagtacagctctgtgctaagcattagggactcaagatgattcttatcttcaaggcatccagcctggggagaaaaacagacgtacaactaagctgcagacggacacatcctttagtgatggggacacctggaagggattgagaaactccttgcagttggccttgggaagctggggaggacttgaaacttctaagtggccctgggagcaaccggagtggnggtgggccagtgcctgtaggcctggggctgcctggctgaggatcccagctggactactgccttgctgtctacaaatgatggagcccttccagtctcagcttcctcacaagtaaaatgcagacggcaatgcctctttccagtgacgttgtgaggattcgatgggaagtttcatgaaagcacttagcagggtttttgttgag

SEQ ID NO: 770 - DNA, 434 bp, Homo sapiens
gacatgtctggcagacaactagaagcacaggtatggagccctgaagagaggtatggggctggagatagtgatgttaacagatatattatggctgaagtaatgagaatgaaaaggcaaggaaatgattcgagaaagtatttctggaaaagggagaagacagtatcaaggaggaaaaagtggtcaatagtggcaaatgcacaaaagttcaagaatggtatttctaaccatatgcaaaaattttcagcataattagtcaatagggaaatgcaaatcaaaattacaatgaaataccactttacacccactaggatggttagaaggaaaaagatagacaataacaagtgttgataaggatatgaagaaactggaacccttatacactgctggtgggattacaaaatggtgcagctgctctggcaaacagtttggcagtt

SEQ ID NO: 771 - DNA, 450 bp, Homo sapiens
tgtgttggtaatggtagtggtggtggcaagatatagatgaaaaccacagtgtgacaccattatctagaaaggctaaaatgacagaggccaaggatctgaagcaactggaatactgagatcttgctggtaggaatataaactagaacaagtatttttggaaaattgtttgacattatctagctgaacatatgcatactccataacctagcagttcccctcctagatatatatccgtagaaatattttcatatgggtaccgaaagacatacaagaatgttcacagcaacattatttttttatagtccccaagctgaaaacaaccaaaaagcccatcaacagaaaaagtggattcagtaaattgtggctgttcatgcaatgggatactttcccacaatataaataaaacttctagtaaatgcaacaaacttggacaattcttaaaaatacatt

SEQ ID NO: 772 - DNA, 179 bp, Homo sapiens
gtgatctaggcctcgtcaatgagagcacttgcatagtcacagtgatcagcccaggagtgaatagggcagtgatctttgtagtttagtcagtgtacgttactatacgttgctgtttactgtcctggctagggatatgaagattacataatccctgtcctcaagaagctcagactgtaatt

SEQ ID NO: 773 - DNA, 368 bp, Homo sapiens
tacaagttaaaggcaaattgagcccatggcctcattgtgctacttagaataccctgtgacccagctctcctcagaaaccctgatggctttgttgcagcattgcattgcacagaagacctcagtggtggtcctgagtcctcacaacaaggtcaacccgtggcctggccactaaggcaacagagagggaaataaattttagaaaacgcttcccttaaaaatgagttaaaatgtacatttgcatcatgagactaggttaactgtcacctgagaaagtcctatattcagaaagacttaatcctggaccaggtaaatgaggcatttgctgtatgttctttgttatgaatttaatgctacaaagagaaaatggg

SEQ ID NO: 774 - DNA, 153 bp, Homo sapiens
agacccctccagtgacaggctgggtgtcccagttgttcagggtgtggtaagcggccttcagccatcagctgcaactcgccagggtcacacccttccctgggacagcccacattgcaaagtcctggacatcctggtccaaccgaggacagccct

SEQ ID NO: 775 - DNA, 631 bp, Homo sapiens
gtaaagactggagacagcataaacttgggggttgttctatcaagccacaggtcatttttcagaatctacacatgataactgaatatatttctacagatttctacatcaattttgcagcagcatttatatcaggaaacataaataatttatctttgttaataataaacatccgtttttttgttcctcacgtatgcgttcatagcaaaaggaaaggttaagacccagacatactgtcgcaaatgtgtatgagtattgtttgtggactggcaccaaaaacactatgccttttgatttttaaacagccagtcattttgagatagtcactgaaaacagatttggccagaatagcaaagtatagatgcagcttaatactttgtttatgcacaaagctgcaaacaaaaagatacaggcaaaaaacctgcttttcaaaacaaatattctattaaagtaaaaaaaaataattttattaacaaaagtataattttgttagtttgaattcctcacataattacttgatttcttcaaaatctttttagtgcataaacacagtcaaggcaaacatataaaatgtgttttctaatccatgaaagtgagaattctgcaaaaccactttgcattatagataaaattt

SEQ ID NO: 776 - DNA, 3390 bp, Homo sapiens
  misc_feature (2276)..(2276): n is a, c, g, or t
  misc_feature (2515)..(2515): n is a, c, g, or t
  misc_feature (2818)..(2818): n is a, c, g, or t
  misc_feature (2896)..(2896): n is a, c, g, or t
cccgagagcgcccattcacccccctcacccacctccccgcgttcccacttccccgcactctgacccggccggacgcccctcccctatcttgccgcccgccccctccagggggctctgctcccaccccagggagcccatccgacctctgcttgacttcccgccgcttccttcaggggcctcggctcatcgggtgcccctccccaaacttccaacccgtttgctccaggagttcctgccccatccccgagggcgcccaaatagccacactgtgtcctcctgtagtcgccgccccctgacctagcgcgacccagcgcccccgcccatgtccccccactcacctcccccggggggcgtggtgagtcgcggtctgttctcacggacggtccccgtccagcctgcgcttcgccggggccctcatctgctttcccgccaccctatcactcccttgccgtccaccctcggtcctcatggtcccagagccgggcccaaccgccaatagcaccccggcctggggggcagggccgccgtcggccccggggggcagcggctgggtggcggccgcgctgtgcgtggtcatcgcgctgacggcggcggccaactcgctgctgatcgcgctcatctgcactcagcccgcgctgcgcaacacgtccaacttcttcctggtgtcgctcttcacgtctgacctgatggtggggctggtggtgatgccgccggccatgctgaacgcgctgtacgggcgctgggtgctggcgcgcggcctctgcctgctctggaccgccttcgacgtgatgtgctgcagcgcctccatcctcaacctctgcctcatcagcctggaccgctacctgctcatcctctcgccgctgcgctacaagctgcgcatgacgcccctgcgtgccctggccctagtcctgggcgcctggagcctcgccgctctcgcctccttcctgcccctgctgctgggctggcacgagctgggccacgcacggccacccgtccctggccagtgccgcctgctggccagcctgccttttgtccttgtggcgtcgggcctcaccttcttcctgccctcgggtgccatatgcttcacctactgcaggatcctgctagctgcccgcaagcaggccgtgcaggtggcctccctcaccaccggcatggccagtcaggcctcggagacgctgcaggtgcccaggaccccacgcccaggggtggagtctgctgacagcaggcgtctagccacgaagcacagcaggaaggccctgaaggccagcctgacgctgggcatcctgctgggcatgttctttgtgacctggttgcccttctttgtggccaacatagtccaggccgtgtgcgactgcatctccccaggcctcttcgatgtcctcacatggctgggttactgtaacagcaccatgaaccccatcatctacccactcttcatgcgggacttcaagcgggcgctgggcaggttcctgccatgtccacgctgtccccgggagcgccaggccagcctggcctcgccatcactgcgcacctctcacagcggcccccggcccggccttagcctacagcaggtgctgccgctgcccctgccgccggactcagattcggactcagacgcaggctcaggcggctcctcgggcctgcggctcacggcccagctgctgcttcctggcgaggccacccaggaccccccgctgcccaccagggccgctgccgccgtcaatttcttcaacatcgaccccgcggagcccgagctgcggccgcatccacttggcatccccacgaactgacccgggcttggggctggccaatggggagctggattgagcagaacccagaccctgagtccttgggccagctcttggctaagaccaggaggctgcaagtctcctagaagccctctgagctccagaggggtgcgcagagctgaccccctgctgccatctccaggccccttacctgcagggatcatagctgactcagatatcgtgttctgaaggatgctccactgttgagtgtaacttgtgtgtgcagaggatgggctggaggactctggatgttggggagaaggacctcttggttcaggttaggatgaaaacaatcatgacctttgcccattctgtcaggctggacgggagggaatgcccccacctgcaggcatgggattaatgctgggcttgaaccccttgctactcacagtgtagtccatggacaatcggcattgccgtcacctttgggagtttgtgaaaaatgcacatctctgcccctgcccaganctgctgagtcagaactgcatgttaccaagatcccaggtgaatcatgtgcccattacagtttgagatgtgctgccttagatcatctttaaccctcagaatgatttgctggatggtttttggacctgtcagtctcccctccctggtatatatgtggcagcagctgcacctgggaggcaggcaggcatgcatgtgggcctctgctctaccacctatgagctctggggcctgacacgagttanttaacctctccgagcctcggttatcccatgtgtaaggtagagaaatgatgcctatcttgcaggttgtcttgagaattaagacaatgtgtgcccagcacccagtacacggtcagttaattggtacgttctgttgttacgacccccggctatccagccccctggcctctccggctgtgtgtcaggaagggctctttgctcccgttgttctctttccatttgcctccccctcttcagccctggcctagcctcccaaagcctgactctggttccccaactccctgttctggctcctgggtggggacnccatctctcagggaccctcccagctcccaagctgctgccctgcctttcctgggggcaaaaggggcaggtggcagtttntttttcagcctcagaactggttttcctcaatcctggggggtccttggacctagaagggaacaactgatggggataaacccagccccttgcccacctgcctctggccttccctggggtcagtgagagaaatgggaatggtagctacttgggtcagcagagtagagtcaaagagctgttcctggtgtgaggtggggcccacgaggcaggcaggtggactctggcacaggggccttggtttctgggggcagggggttggggaactcttggtcgccagtttacctgccataggtcccttttcagccctgcctcccccaagttccatcaacacaaactcccagggggtcctccatgcctggcctggccctctccttggtgctgatgagacacaactctggccccggcggctggcctctgaggggccatggtgcttgcggggcttcccctatcccccaggtctgcccaaggggactctcaataaactctagctgaaggca

SEQ ID NO: 777 - DNA, 361 bp, Homo sapiens
tctctcttaatcctttgatcattctctgtggaagctcccatgcgtgtttcttcttctttaatccttaactagattgtttgccattggctttgagtggaatccagttgttgactaataggactttcatggactctgttaaattctgcattggttgctgatttgcagttctagtttgcaacttatttacatagtttagtcactatatcatctgatattccaacaattagcaggagttcactgttggattaaataagagattaaaatgtgtaaaccggtcaggtgcagcagctcacacctgtaattccagcactttgggaggctgaggcggaaggattgcttgcgcctaggagttcaagaccag

SEQ ID NO: 778 - DNA, 658 bp, Homo sapiens
aaagttaaatacagttaccacatgacccagcaattccactccttaggttacacccaaaagaaatgaggacatatgaacaacaaaaacctacacaatgaatgttcataacagcattagtcaccttagtcaaatagtggaaacaataaaaaacatcagatttcaaacaaataaataaaatataccatatccataaaatgagtttgagaccagcctgaccaacatggcgaaaccccgtctctactaaaaatataaaaattagctgggtgtggtggtggacgcctgtaatcccagctactcaggaggctgagacagaagaattgcctgaacctgggaggcgaaggttgcagtgagccaagatcacgccatttgcactccaacctggggcaacagagtgagattctggctcaaaaaaaaaaaaaaaaaaaaaaaagagagtggagtgctgataaatgccacaatatgaacgaaactttagaatattatgttaaacaaaagaagccagtcacaaaagaccacattttgcatgattccattcatatgatggtctagaacagacaaaactttagagaaagattcgtggttgtctacagcagagagaaggggtactgagaagaaatgggagtgaccgctaatgggtatgggatttcttttgtcgagc

SEQ ID NO: 779 - DNA, 411 bp, Homo sapiens
attaaatatcattacctgaataaagtgtctaccctgagtagaaaaatgaaccatctgccactatactttatgtggttaaatgtctatttaaagttaacatcccgtcattcactttaaaaaacagaaaagctttatttaagaaaaatgtaacttaaagtaaggccccaaagcagaggtcagatacaaaattaagaattttttcccttttctttctgtggcaaaagcgtatttgactaacgacttccattaaaataatggagcaatgtaatatttctttgtgtatgaaaagaaatctttaacaacattgacacttttggattagaagtttttagatgcattttgcataactaatttgaccaactatattggcaaagaaatgtggaaacacaataggcaaaagcaggcttttaa

SEQ ID NO: 780 - DNA, 346 bp, Homo sapiens
atatgtttaggttttagcaaaatgtctttaattctttattaaatagtcaagctcatggggaaggaaatcgtaaaactgtaaaaatattaaacacaggagcttgtattgagcaatatataacattttaggatgatgcatctcttaaagaaggtttgataatgttgcattttcattgaaattaactcatagaaatgtgaaacattatcatttttcattccagccattgttttgtaatttctattacctaaagtgtaaattaaccttgaggttaatttaggttagaggtctgtattgcataatagagaaaaaccaacaagtcttattatttctaggagaatttagtatc

SEQ ID NO: 781 - DNA, 890 bp, Homo sapiens
gatctttacttaagattcggactggaacacaatacttgttccaaataacctccccaggctattcctgagagagggggtaccttggtttttggagtaggccagaagtttgtggtaggaaaggtgactgatttgcagctagactcacctgctaaagtagacacgggtctgttgcactgcaggttttgagaacagcctggaccaaaccacacagtgaccccaaaggcataaaaatgataatgaaggcagcgatggctcaactaatatcatgaagtctatgcatgaggctgcctactttgatttgcagtagttgatactttaaaacttcagtcctggcttatctgcctgtcccagggattcctgggctcccaatagtgagccaggatggggaagagctagctccatcagcacacactacatgtggacagttggactggactgttttttaaaagcacaaactcaacatttttagatcttcgtctaggattctgacttgaaaacaattcttgttacaaacagactctttatggtggtgaacaagcagagattgtaagggcccatgaaagcaatacttgggtgtgaagagccgtcatattcctaatggattcacctccaggaatctgatacatggacatgcattttaactgctgcttttattacctcccttaaaaaattagttctgtgaaattcccttgccacttttgcttggaatacatttcctttagttttctacctaatataatcttgtagcccacgtctcagaaacccagaggtccccagttgtgtcatgtatgtttcattctcacttttgattacttgaggccagccgagatctgtgtggataccatattccttgctattttttggtagcctgtgctactaacaatcaaatt

SEQ ID NO: 782 - DNA, 458 bp, Homo sapiens
ttggctcatgtgattatggaggctgtaaagtcccatgacagactgtctgcaagctggagacccaggggtggcagtaggggtagcgtggttcagtctgagtctgagggcctcagaaccagggaactcgacggtggaaccctcagtatgatattgaaggcctgaaagcaggcggagggtggagggtgctggtgtagttcctggagtccaaaggctggagttttgatatccaaggactagagaagtgtgtgttgcagctccaagagagggaagtggtgggagaagtagagaaggatgggaggagagagggagggaaagacaggagggagacccttgtctctgcctttttgttctatcggggccctagctgattggatggtgctggcccacattgtgggcgggccttcctcactcagtccacttaccctctgccagtctggaaacaccttgacagacaccca

SEQ ID NO: 783 - DNA, 388 bp, Homo sapiens
agccccatccagcagtcacccttaatcccactcagagacagccctgagagtgttcctctcgccacggggctcctcagggacctcctcgccgtccgagaggtcagcagaattaagacatcaggtatcagagggcgctggcatctctcacaagcagagcctgtgcacacatgtgcctgcacacacaccctcagggcccatgcagagaggccgatcttcaggcagaggtgctgtgggttggggattgggggcgggggtggccgctgaatcctcagtcccttccggaaccctggccctgctttcttgccagggtccccaccccctcaatcacctgtctcacctgctaggacacctgctgtgtagctcacactggttctctctctccatcctc

SEQ ID NO: 784 - DNA, 191 bp, Homo sapiens
gcgcccttctccgcccagggcagcagcgcgcggggcccccgggagccgaagagcaggcgggaactggcggcggcgcgggaggcgcagggagcggaggcggcagcagcggctcccgccgggactggtaattacgctcggggccgggccggggcgagccgggcaagcggcctctctgggtctccccgtctttc

SEQ ID NO: 785 - DNA, 292 bp, Homo sapiens
gtgagctgctttgaggaatattagaaaggaatgttttgaagaaaagaattcatgtaagtgttttttaaagccaatcaatatttatataggtatgaaacagtttttacatttgccttttaactataatatagcatttgggcaaacaaagacaacatttaaagtgaaaaatattttttttctattgctgatactcatactactcacgttattgttaaggttataatgtacacataattaaaattaaaatacagtttttatactctctaaagggcaaaataaaaagtaattatat

SEQ ID NO: 786 - DNA, 269 bp, Homo sapiens
taaataaataccatgaaacaatagaaaaaaattatgtttatatgcttttttccctggaagaagttccataacttttaaaatattcccaaaagggtccatgttccatcaaaaggttatgaccaattgaatttagtggtgattcagatatataataggaacaagcccagaatatacccataaggaaaaaaacatggagccggattcatgaaaccttgccagtgaatgaaacagtatgacactccaaaacctccattttcttattttcttat

SEQ ID NO: 787 - DNA, 964 bp, Homo sapiens
agatctcaggccagagccacgagttatgaaaaattattcccaggtcctaagttccactctaggaacttctaacattgccaccttgatttcagaattatgtgcaccaataactatgttgttcctctcattttttccacttttgagcaagaaggtcacatggcagttaccctctgcctgtcctaccattgtcttttgggtatgtgttgggcaggtaatttgtctcttaagttccagaaacgagattgagagaagcaatatatattcaaggagcagcatttaaggaactacctacacccaggaaatttcatctgtacctgcacctgtttagaagacaacatcctagctttgaagatgttcctgtaaaaagatgagacttttagggagtcatgggagggtagagtgtattttgaatatgagaaaaatataaataattggtgttcaaagagcagtgaagtatggtcgttttaaaatacggaaacattattttatacttctctcatcattggagtctaattcccctcttcctgagtgtaggctgttcctagggactcacttctaccacacggaatgtgttgaaaatgaagtgtgacttctgagggtagatcctaagaaaatttctggattccatcttgctttctctcttggatcactctgggagaagccagccactatacgtgaagacactggaggagagatgtatgaagagatccatgtgaggaattgaggtcatctgccaacaaccagcaaggaactggagccttctagcaacaaccacatgaagtgaaccatcctgaaagcaagtcctccagccacaaacaagccttcagataattacagccactgctaatatcctgactagaacttcatggggactatgagccagaatcacccagctaaattggtcccacatttctgacttacagaaactatgagataataaatgtttgtgtttgaagctgctaag

SEQ ID NO: 788 - DNA, 599 bp, Homo sapiens
aagaatgagatttgaaagtggaccatggttattcaattcccttttacccagaaactttatgctagcaataatcattaatgtgttttttctagcatatgttttaaactttactccacattacttgattcctcagatctgacatttttgaccagatactggtccattagcagtatagatacatcgaagaactaaaaggtcattcttttgttttgttttttgtttttttgagacggagtctccctctgtctcccaggctggcatgcagaggtttcagtgacctgagatcgcgccactgcactccagcctgggtgacagagcaagactccgtctcccaaaaagaaaaaaaaaaaagaagcaatagcattgattgaagtaaaggtaaaggtttgtagcctgggcaacagagcctgggcaacagaacctgggcaacagtatctacaaaaaaaaaaaaaattgagctgggcatggtggcacatgcctgtattcctagctgctcaggaggctgaggcaggaggatcacttgagcccagaagtttgggtctgcagtgagccatgattgcaccactgcactccagtgacagagtgaggccctatctctt

SEQ ID NO: 789 - DNA, 1224 bp, Homo sapiens
ggttgcatacccaggtcatctaaggagcaaatgaaaatctgtgactgaagaaagaattcaccaagttaaccagacacaaaattaacaaaaacatcagtagctttcctataaatataggctataatggagggtcattttttatttttatttagagacagggtcttaactgtcacctggactggagtgcagtggcatgatcatgtttcacggcagcctctaccttctgggctcaagcgatcctctcttctcagccacctgagtagctgggcctacaggtgtacatcaccacgcccagataatttttattgtattttttatagaggcagtgtcttgctatgttgccaaggctgttcttgtactcctggcctcaagcgaacctcctacctcagcctccccaaatgctgggattacaggcatgagacactgcacctgaccagaagtcattttttcaatagcaacccccaaaaaagataaaatacctagtaacaaatagggaaacacctatgtgaaaggtattataacattactaaggaacacaggccctgaataagtgaaagttctgttgattctcacattttgctatacagtatcttaagatgtaaaaccttcctttaaaacacaagcggattctaaagttaaaacagaaaagcaaatatgccagactagtcaaattgttttaaattctgctgtttttagaacattgtaattgaaacagcatgatgctggccctttaaaaagattcctggaacaagaaagtccacaaataagccaaatacacaggaactcggcgtggcacaaaggggccgtgtgtgatcaggaactggaactttgcaacaactacccatgctcagaagtttgggccaccttgaaaagagaaaagttggattagactcctttttatactaagggaagttccaagtggtcaagtatttacgtgtaaaaaaatacatatatatgaaaccataatcataagatactttttttgtaaattgactattattgtataaatttatagagtataaagtgatcttataaattatgcatacattgtggactagtcaagctagttacatccatcacctcaaatacttaacatttttgtagtgagaacatctgaaatttactcttagcaattttgaaatgtacaatactcaatttttgactgtattcaccatgctgtacaatagaactcagaaaaagaaaaatatagtcctcctttctaag

SEQ ID NO: 790 - DNA, 736 bp, Homo sapiens
tacatttacgcctcatgccctccctgggtgaagaagataattaaagtcatctgggcctccacaagctacacaggaagtcaaggaaacagtgatagcgaacaagaccatctagccctgtactctcctcattccctgaacactttttaaaaatacccagaaaacctaatttcctggaacaactgactttttatcagttaggaaagagtgaaaaatagcaaatgacactataatttaattctcaaaacaacaccattgttatccctgtatcacatagatgaaaaaaggtacagacggttaactatctaatccaggccctagaaactagtagacagaaagttcatcttttctagactggcgcggtggctcacatccataccacagcactttgggaggccaaggtgggtggatcacttgaggccaggagttcgagaccagccccgccaacatggtgaaaccctgtctctaccaaaaatataaaaattagccgggagtgatgccacatgcctgtaatcccagctacttgggtggctgagacacaagaattgcatgaacctgaaaggcggaggttgcaatgagccgacattgcaccactgcgctccagcctgggcgactgtaagactccgtctcaaaaaaaaaaagttcataaaatgaagtctctcagtctttccctaatatgaagtaccatccagaaaccagaaggtggagttgatgtgatattctatgttggcgtgaacat

SEQ ID NO: 791 - DNA, 964 bp, Homo sapiens
agccttcaaagctagtggcagagggtagctcccctcctgcctgtggcttgtgctggcctagagagtatagggcagaaggatggcagatgagtgactccacatccagagctgcctccctttaatccaggatcctgtccttcctgtcctgtaggagtgcctgttgccagtgtggggtgagacaagtttgtcccacagggctgtctgagcagataagattaagggctgggtctgtgctcaattaactcctgtgggcacgggggctgggaagagcaaagtcagcggtgcctacagtcagcaccatgctgggcctgccgtggaagggaggtctgtcctgggcgctgctgctgcttctcttaggctcccagatcctgctgatctatgcctggcatttccacgagcaaagggactgtgatgaacacaatgtcatggctcgttacctccctgccacagtggagtttgctgtccacacattcaaccaacagagcaaggactactatgcctacagactggggcacatcttgaattcctggaaggagcaggtggagtccaagactgtattctcaatggagctactgctggggagaactaggtgtgggaaatttgaagacgacattgacaactgccatttccaagaaagcacagagctgaacaatactttcacctgcttcttcaccatcagcaccaggccctggatgactcagttcagcctcctgaacaagacctgcttggagggattccactgagtgaaacccactcacaggcttgtccatgtgctgctcccacattccgtggacatcagcactactctcctgaggactcttcagtggctgagcagctttggacttgtttgttatcctattttgcatgtgtttgagatctcagatcagtgttttagaaaatccacacatcttgagcctaatcatgtagtgtagatcattaaacatcagcattttaagaaaaaaag

SEQ ID NO: 792 - DNA, 336 bp, Homo sapiens
aggtgtaatagttacacacatggttctttgcagtgggacagactgaggcctccacctgttctgccaccttctatctacacaatcaggacatgttctcaaaggttatttgctgcagcccagtcctcttcctattctcatatgaatgtcaaagggcccctgatccagccccacaacacccagggcccttttcttaccccaagcctctcaagcctgctgttccaccagagcagcccagcctgcacactgtcagcctggcctctgtctaggtacgcccagccaggctcagcgctgctgaccacaccaccaagactgcagagaggctgagcaaacagccct

SEQ ID NO: 793 - DNA, 428 bp, Homo sapiens
tcacctgatataccttatttatcccacacccaccccaataacatatcgtgctcactgttatctttgaggcaacccttgaattttactcagcctggagcgctcttcacgtcttgtccagagccagttcggactcattcttcagccgtgcatcagtcagtgggggctagcttaaactgtggtgacaaacaacctccaaatttcagtggctcaaaaatcttcttccttatttatttacatctcatgactggtcaggtgagaggtagctctgtgctgtgtcatcctaacacaggaatccagaaggaaggagggaccgtcaatgagatccccattgctatagaaaagagaaaaaagcatgcggaatagaacgctgtttcttggagatttctcctgaaaaagtcacatgttatttcttctcacctccatcggca

SEQ ID NO: 794 - DNA, 368 bp, Homo sapiens
aagtgtcacatctttctattgcatgatgctgcttcttgaacacccatagtagccaaggccagaattagtgtggcaccctcttccccagacaaggtccatggacagtgcatttcaaaatacaggaagctctccttacactctctgctacctagcttccatggttatcaagtaattatactttatgctgagccaacttatgcatttaggaagagatgaagagaaattatatcctcaaatgggctggaacaaaagggaataccaataatttgtaagttaatcaaattataattaaagcaggaagagacacaaggagcttggattatctatgttttctgttagaaaataatacaacaaaagtatccagggag

SEQ ID NO: 795 - DNA, 358 bp, Homo sapiens
ggtaattttaaatggaaagttattgggggaaaagccatctttaacttgctcaggacagcatttaactatgccagtagaactcaaaccttgaacaccccatcagaaaaagttctggacacgcacctccaataattttgttttttgagacagtctggacaagagcagaactccatctcaaaacaaaaaaaaacccaacaaaacaccaccaccaccaccatcaggcttatggcgtaatcccaggattttgggaggctgaggtgggcagatcacttgaggccaggagttcaagaccagcctggtcaacatggagaaacccccatctctactaaaaacataaaaattagtctggcgtggtggt

SEQ ID NO: 796 - DNA, 432 bp, Homo sapiens
gccttgctcgcatgcttttaggaggtgtactttcttagtgcttcagacttctgacctcactacacaccctcctcatcctctacagccgtagtctgctctctatgaatgaggggtcttggaaggagctcttgagtgagggcaagtgtccgaccactctcccagtggtggcaggcctctctttttattaatattggcttgggacgctgggttcaagcagctttcccatccctcactcagctgcaggtggcttttgctgctagccctccctccaccccagtgtacctttgttagagaccaggggcaggagagtttcctactctatacccactgtcttcctgattttacttcatgtaagatggggtttagtgtccatgtcccattgagagagggctattccaggcaccatctctgccccatcttgtgagcatgtga

SEQ ID NO: 797 - DNA, 454 bp, Homo sapiens
aaaaaattagccagatgtggtggtcctgtaccacccagctactcaggaggctgaggtgggaggattgctcgagctcagaagctccaggttatgatcataacctgaagctatgatttggccactgcactccagtctgggtgactgagagagagagaaagaaaagaaaagaagagggccaggcgcagtggctcacccttgtaatcccagcactttgggaggccgaggtgggtggatcacgaggtcaagagattgagaccaccctggccaacatggtgaaaccccgtctctactaaaaatacaaaaaattagccaggcatggtggtgggcacctggagtcccagctacttgggaggctgaggcaggagaatcacttgaacctgggaggcagaggttgcagtgagctgagcttgcgccactgcactccagcctggcgacagagggagactccgtctca

SEQ ID NO: 798 - DNA, 1969 bp, Homo sapiens
attttgtatgcgatcgtggcaggattgcggacgggcagcactctttctgcagaaggtaaaaatcaccttgctgaggaagcttttcgtctgctgattcttctttgtgacatcggggaataaggatttatttctaacagtcttgggggctcgtctgggatcacccagtctccttcgggtcggggtctctgattcccgcccccccaccaaggggaggcgccccactgccttactgcggtggcctcagggactgggaatccggacttacctgttgtgatgaataaacccggaccctcagcaacgtggaaaacggcgaataggcttgcattgcactgcctcggggaccagataaactctgttcacagagcaaagtaaagaaacgtcgcaagggtgcgacaaagtacttgcttggtggtcgggatattctggaggttaaaagtgtgtgtgaatagtcacaagcctcactgcagctggtgttgcttgtgtaaatcatgataagtcctactgctggaccgagcgagtgagtcttgcctgcggttccgtggctacctcatacggcttaaggcggatcttgccttggggtttataccggcacgccaatgctaagaggggcctaaattcccgtgaggaaagtggccaggtaggacaaagcgagtgaagagtgtaaaaagcctccagaaagaaaaagaggagttaaatcctcctcagggaaaacgaaacctcaagcacgtaaggttaaaaatataagcaagccaggaaaaaacaggatagacaagaaatctccaggattaagaggttaagtctacctgatattcaatatgggaaaggtttctagtaaatcgggggcaaaaaaagatgcaagttatcaaatccctcccgatagtcctttaaggctcatgttaaagtattggaaagataataaaaaaactaaattaaaaaaaagcagcagataattaagtattgttgctttatttggactaaaaagccaattctcaagccagcggttttttggtcaaaatttaggtcagataaagattaaatctgtcaacttttaataatatatgtttatagcaaaagtcctgtgtcacaagaaaaattgattatgctttgtgctagcggcaagggcctatattattctttatcctttaaaaacgatcaaagggggactagaaaataaaaaacagtcaaaaatggccttatctaataagagataggaccctctagaccaccttcccccgtttcttaataacctgccgacacctccccaggtagctgctgctgtcctagatccccttctggacctgatccctgacccagctgccactccaggcccccctgccactccaggcctcccccatataacccagattcttgtgaatcccaggagcctaaaaattctaaatatccttctttaaagaaaagactccaacaaaaattaaaacaatgtaagaaggatattcagaatttcccttttcctgccccccaaaaaagttaacttcaacattctttcctttaaggaaagttccccaaggaggagaagctattggttttgtggatgctccccttactgggtctgaagtttggagtataaaaagagaactaaagccactgttaaataatcctaacagggtggcagatcaaattgatcagtttttaggcccacagttatatacttgggctgaatcagtgtgcatcctaggtattattttttcaaggaaaaaaagaaatacgatctgggaacgtaaacatcctccaggtcaaaatgttctggcagcaaatcataaattccctgctcaggacccgcagtgggataaaataatgctgcccaccgaaataatataaggaattttttaaaaaataataatcagggggattcaaaagtcagcacccagaccccaaaacctttccaaagcatttaatgtccaacaaaagaaagatgaaggacctatgaggttcatagataaattaaaag

SEQ ID NO: 799 - DNA, 1416 bp, Homo sapiens
gcggccgctgattggaccgtttgaatgagacgccgccacggcccggcatacgcgcgggcgcgccctgacgctgaggaagtcgcgcacgcgactaacggtcttcctgggggccggagcgtggcgaggggaggcgggactcggggttttaaacgcgtgatggaaggcgctcgggccaatagggatgcgctttagtgactggtgggtcacgagactcgcatgggccaatgactgatagagaccggtcagagggcgacccagtttcgtgcagatcaaaccgctgccagccaacgaaatccgttgatttttgtatatgcaaatgaagtgtgcgctgccgcccgcgccccctcctttgagccgtggtggaggtgggcgctggaactccgactacatttttctatgaggcgccattttgtgctggaaatgctcttggacccacgtcctgtattgctaaggctcaaagatcagtcagaatgaccttgaaggcttggacagccttgcactccgtgtgtgacccccactcctgccaggcttcatcgaagacgccagcctcagtttccttatgtgacaaatgggcactgggatccgttgtattgccagggaaagaagtcagagagtgccaagacggttattcacggcatggttatgcctatgactgacccatggcctccagccacacccgccttctctgggactcagtttccctctctaggaaatggacacatagctgcctggaaaagggaccatctccagccctcagtgtcagtaaaaacgtcaggcaattgcttgagaacggtggccagagctccctgagcaggccttttggaggggcttagagaggaggagggaatgctgaagttggccttcctttgctcatctgtgcagtgcggtcgcagtgccctctcggtgtctctgccagatctgtgcgtccacagctcttcttagtttcttggcctttttcagccatggatgagagcattaacatctgggcctaatttggccacaggtacctgaaaagacccctggctaccagcttcccctcatggggcctcagcttctgaagaaggaataaggaaggtgtgaaagaaatctacatggccaaggccaggcgtggtagctcacgcctgtaatcccagcactttgggaggctgaagctggcagatcacctgaggtcaggagtttgagaccagcctggccaacatggtgaaaccccatctgtactaaaaatacaaaaattagccaggtgtgttgatgcagccctgtaatcccagctactcgtgaggctgagatgggagaatcggttaaagccgggatgtggaggttgcagtgaactgagatctcgccactgcaccccagcctgggcaacagagcaagaccctgtctcaaaaaacaaaaaagcaaaaaaaaaaaaaaaaccaa

SEQ ID NO: 800 - DNA, 597 bp, Homo sapiens
acattactctcaaaggagaaacaatagcactgaaaatcacttgtcaacagaaatgatggaagtgagaagataatggagtgccattctgaagttcctcaaagaaaaaagtgtcaacctgtaatcctatattcacaaaatatacttaaaaatgaatttgaaatagatgtttctattcaaaaactgagaaaggctgggtgaggtggcctgtaatcccagtcctttgggaggtcaaagcgggcagattgtttgagttctggagtttgagaccagcctgagcaacatggtgaaatcccttctctacaaaaaatacaaaagaattagccaggtatggtggtgcctgcctgtggtcccgctactcgggaggctgaggtgggaggactgcttgaacctaggaggttgaggctacagtgaaccatgatcatgccactgcactccagcctgggcgacagagtgagaccctgtctcaaaaacaagcaaacaaaaaaacacaaaaaaacctgagaaaatttgctgtcagcagatgtgcatacacaaaaaatactaaagggaattcttcaggtagaagaaaactgatctatgatagaatcacagaaatgc

SEQ ID NO: 801 - DNA, 380 bp, Homo sapiens
caagtgagcagcagggccaagacggaacgacctctctaaggtgtctctcacgatgtgatcctatcctctcattcggaagtaggatcctactgagcgcagtggctcacttctgtaatcctaacactttgggaggccaaggtgggtgaatcacttgagctcaggtgtttgaggccagcatgggcaacatggcaaaacccagtctctactaaaaatacaaaaattagccaggcagtggtggtgcgcccctgtggtcccagctactcgggatactgaggtaggaggatcactgtagcccaggaggtcgaggctgcagtgagccatgattgtgcccctgcactccagcctgggtgacagaacgggaccctgtctctcaaaaaaaa

SEQ ID NO: 802 - DNA, 341 bp, Homo sapiens
ttttacgttaagttccctttgtccagtgggacatacactgacacctaggcaatttgtgatgccatagacgttcaaggtggcatggggacagggctaggagtccaatgccttcagtcctttctcacctgatgatgccagctcccattgttccatctctctgggtctccacccacaatccttaaatcatgtgtgcagggccttgtccagcctggggactctttgtactatatttgggctgttcttgagctcatgcaagctatttggctgctcccaacatgcagtgaggcaagagaaactctctgaggctgtccgggtctcatgtcaacctccaggccactcta

SEQ ID NO: 803 - DNA, 483 bp, Homo sapiens
gaaaatggtctaacaccaatttgctgtctaagtgcctaacaacagggttttccatggttttaaggtaaagaatcattgattatttgaattattcaaaaagtatgagtaaatttcctagtatattttaagtgttgtcttcacttctattttaattgaacattctaaaattgacattcacagttgctagtacatttttttccatttcaaataagatgatgagcagccaaagaatgtcttagatattagaaagtgcaaatggcaaaattgcctctattaaatatctttttaattcaggagagttcacagccagttaggccaggtaggatgtacaggatgagctgaaatgagaagcatgggtcaggaccacacaaggtgattccaaatgtccttgtaggagttagggaacacagccagctcccttagagaaaagcctcttatgaagccctaaattagacatccaaaggtccagaatcagggcagcca

SEQ ID NO: 804 - DNA, 451 bp, Homo sapiens
acaaacatatcagaactgacactcagttcaaatgaagaaagtaggaattgggcgtgccgtgttattttttcaaagattctcctattgctccaaattgttggggattatcttaaagtctttgaatagcttcagttatggaagattttaccctctgagaatagaactgaattttagacaaaccatgagtccattgtagctagactggcatgcaagttgggattaaacagagtaaaacgtcttgtttaaaaaaataagaaaggccggcttgggcaacatagtgagacctcctctatgaaaagttagctgggcatggtggtgtgcgcctgtggttccagccgctcaggaggccgaggcaggaggatggaggtcaagactgcagtggactgtggttgcgccactgtactccagcctgggtgacacagcaagaccccgtctcaaaaaaagaaaacag

SEQ ID NO: 805 - DNA, 144 bp, Homo sapiens
aatggagtgggaggaatagagaaggtggggttgcaagaggagaaaggcagaggaatttcctaccgtcttcctgttttttgttgatggttagtgattaatgagacaagctgttctgtttctctgggagtcttgactgtcttgaag

SEQ ID NO: 806 - DNA, 679 bp, Homo sapiens
tgtgtgggcgggggttggggctaaggtactctcagaccaccagtcactatacaccgatgggtggtgccagataaagcattttgtaaggtgacagcaacaagatctgtcctcattcacacataccagaagcagcagcaatgcagcagggtatacacttgttaggtgcagcagggtgctagcaggtgccagggtgggtgggtgcctgactccatgtgggtgttcacagcagtgacggaggcagcacacaaaattaaaattcttaaaggtggtcatacatataacaagtgggtcaaggaagagatgaggtgcaagacaaagataaagcacatgccctagcacagtttacaactgcttaaaagaaagctactaaaatgcagacaccaaagtaacaggtgtctgttagtctgtcttctttaacactcccactatcggccaggcctagtggctcatgcctataattccagcactttgggaggccaaggcaggcatgagcctccgtgcccggatgatctcactctttctatggctgtatggctgcattgtattccatggtgagtatttaccacattttctttatccagtccaccactaaggggcatttaggtcaattccatggctttgctattgtaaacactactgcatgtgacacatgcatgcacccgtaagatcctgagagtca

SEQ ID NO: 807 - DNA, 335 bp, Homo sapiens
gcatattccactagctcttcctgagggctccactctccacacttccatcctctgcacaagctctttagctttctgggttgtctgctccattgatacatttgcccaggatctgctgtgtttcagtatgttcaaatttttctttttgaactgattttcacactaagctcaaaagaccttctccgtccaccccttctaaaactctcaacagcacctctactacaggttctctcatgcaatcactgtctccatttttatcttcttgtaacttatcaactccttgaaataagagactgcattgttatttgccatatatttatgtgggtaagggctcaaaa

SEQ ID NO: 808 - DNA, 612 bp, Homo sapiens
atatgatactgggcatatggcaatgctcagtgaatattggacagctaatacaatttgcagagtcactgaggaaaagtatagcttcagagagcttctgtgtccagatttcaacgattttctttcatcattatttcgtggggctcccaggaccatatgtggctcacaaaccacaggctaggatgtgtttaacgttaaaagcaagcagtgtgtttctctgaagtgtggctccaccatggtgttcggttacacccagaggaggaggctggtgggcagtcatagaagtgcatcttccagagcaggaagggatcaacagctcttcctgggagacttccattctcctaccccagtttctgagcacagcatgaatctaggagggagtttctcttcttgcttttcctcctagttttgtttcctctattcccttttccttgctaaagtgtgttggatggtcaggaatgtgggcggagaagagggggagctggagacatctcatcctttcatccagcttgtgtaaaaatgcctcagaactccctcataccacatgcaccataaattataaggtcaagctttgtaagcctgcagccctcttggctttttgcatgttggttagaa

SEQ ID NO: 809 - DNA, 434 bp, Homo sapiens
gcatggtctcgtactcctgggcctggtgctgcccctctgcctgggtctgtgccagctctgactccaggtgcagcaggattctgttgagctgctctacctgcagggcatagcaggtctccacctccctcaggctgttctccagaagctggccttcagatttcttatcaagtccagatggatctccaaggactggaccgtatgtctcagctccgtgagtgtcatctcagcagctccgacctgcgcggactgagtggtgaccactgtggtgctctcctcaatctgctgagaccagtacttgtctagctcctcttggttcttctgagctagctcgtcgtattgggcctgtatgtctgccatgatcttggcgaggtcctgagatttgggagcatctaccttcacggtcaacccagagctggtgagctgggcttgtaggc

SEQ ID NO: 810 - DNA, 568 bp, Homo sapiens
gatggtggtcgtcccggagggaaggcctcggccctgcgccgctcccagcctattgttctccgtggacaccgcgatatcgtggtttttgtttccttagcatgcacctggatgcttacaaccaagacccaatctgtgaggacgaggtgaagggagacggggctcaaccctctcaattaatcccttcactttagcaacaccattgcatgacctttgctctcgccacgggccctctgtggtcttagacctggagaaaagactttaattcagacctctttttagaactcgtcgaaccttccttttgtcctatgctttctttccttttcccgcttctccccctttttgattaacctcttcttatctttacagccgtctccctttaattttacttttgatttcctactgaaattcttcctttcattttcttctcggtgataagattttttttcctcctcgagggtgcttgtactcattttcagtgcagtaaactttattcttgcagttgccaattggaaaaaagccaagcatttttctttaacctctggctttccttctgtagcacccaccgacc

SEQ ID NO: 811 - DNA, 390 bp, Homo sapiens
gtttgtgccttcagtctcttgcctcagcacctgggtaatcctttgcccacacatttccgggtggctctgctctcctcttgccattctctttctacacacctgctccaagttctgactcccactccctcagcccaccccagtgcccacaaccctcctatctctctccagccctgacctttcttgggacacccagagctgcctgcagaatctttgccttcccacttgccaagtctgaaatcacactcagcctcctaaccaggaccacaaaaccaactcctccaactgcccttgcatcatcagaggaaccccaagctcttgaagtgtgctctgcctcttctcctttctaatagcactactcatggttgcatctgttctttttaaaaaaaaaaa

SEQ ID NO: 812 - DNA, 321 bp, Homo sapiens
cagctcagaaggaacactgagtgagggacagatggactggtccggcaggggacccgcccattcagcagatgtccctgggcacagctcacatgtcagttctctgcaaagcggacaggcggctgagaagtgtcagagcctgctaatgagggctgggcaagagagaagcagaagcgaacttgcctgggtcgggggaaggggatggtgcaaagcaaccctgaggccgaaagcctgtgtagctagaaccaacgggggtgggggcgggcgctcagggctcagggctcaggaaaatgaggtggctctcctagttttaccagggaaagg

SEQ ID NO: 813 - DNA, 267 bp, Homo sapiens
tttttttttttaccagaatctcactgactaaatactctaagtataaaaataagttctaaaaaaaattcaacaaaaatgtagaaaaatatcttctaaaacaagactagaaagtaagaagccattaggaagaaacaatgggtcatttagcaaacataattgcatatgtagacatctaccaagataaattaatatatatttggactgatttatattccaatgatacatttattgtgtgtattaatgagtatgggtagccctaaaagatat

SEQ ID NO: 814 - DNA, 1411 bp, Homo sapiens
gctcccatgagtagtaaaatgacacagtagttaggtttatgtccagtcacagcctcttcccatttccactgggaatgccttacctaatgagttaagacaatgaaaaaagtaaaccagttagaatacttacactttctgatttaaaactcagtaaaactatagtaataaagacagtatgttactgacataagaacagacatacagaccaatggaaccaaattgagaattcagcaataaatcttcacatttatgatccactgatttccaacaagggtatcaagataattcagtgtaaaaaatagtcttttcaacgaatggtgctgggacactgggtctacacaagccaaaaggaatgaaattggactctaatctcataccacatacaaaaattaactgaaaaaggatcagaaaccaaaatgtaaaagctaaaactgtaaaattcttaggaaaaaatacagatgtaaatcttcgtggtcttggattaggcaatggtttctaagatatgacaccaaatgcacaaacaacaaaagaaaaaacagatatttagacttcacaaaaagcaaaaacttctatgtttcaaaggtcactatcaagaaagtaaaaaaaaaaaatccacagaatggaggaagatagttgcaaattatatatctgatgtacaggacttatatccaaaatgtattttgaaaaaactcttacaattcaacaataaaacgacaagtcattaaaaaatggagcaggatttgaactaacatttctccaaagaagataaacaaatggacaataagcacatgaaaagatgctcatccatcatccatcagaataatgcaaatcaataccacaacaaaataccacttcatatctactaggatagctatcattaaaaaaaaaaaaaggacaacatcaagtgctgccaaagttgtggagaaaaactgggccctcatacactgctggcaggaaacacagacttactatataacccagcaattccactgctaggtacatatctaagagaaatgaaaacaaatgtctacccaaaaacctgtacataaatgttcataacagcattattcatagtagcaaaaaagtggaaacaatataaatatccatcaattgatgagaagaaaaataaaatgtggtatatccataaaaatggaagtttatttggtaacaagtaggaacaaaggccagagcaattaggcaagagaaaagaaataaagggcatccaaactgtaaaggaaaaagtcaaatcagccttgttcccagattacgtgatgttaaaacctaaagactctaccaaaaaaaaaaactgttagaactgtcaagaaattcagcaaagttgtagaatgccaaatcaacacacaaaaatcagtggcatttatatatgtcaacagcaaataacctgaaaaaaatc

SEQ ID NO: 815 - DNA, 494 bp, Homo sapiens
gacttagaagagttcatatcaaatagtgttattgaagtatgcagaaattatatttcacccacatcagtaaggtcaaatgccttatcctcagcaatgtgtaccaggttgataggacattgccacagtcccaccctgtctgatctattggcaatcttatacagtccgattacatagtagaggtaacgtggggtggggtcaggagcctgtgcgtgggttccagcccactggaccctgcatggcagagacaaggggcatgctcattaaggggaagggtaccccttgctatttactgtcttgaaaaatatgcttcccttactgttagtcagagtcttgctgcttcaaaaccacatcagcacaagagtgttttctcagcagacaacctcgtgtttatgtcgttctctacaaacacagctatcattcttcttaaaggggaaggcactgtactttgcctctgattctaaatgggaatgtttaaaaccaaccaagtgcccgag

SEQ ID NO: 816 - DNA, 342 bp, Homo sapiens
tctcgcctgctgtcggctcctttgtctgcgaaacacattttctcttattatcaccttgttctctgcctgccttggatggtttcagcttgtctcttaacatcaagatgttgctattaacagtcttctctttcttaacagcttacagtcacttccttttattcagtccttttccttttccctcccaaaccacgtaatcatctctttcagcctcaaataaaagttgtataaccatttcataaccactgctttagagttgctatcaaaaaggcacaagaagaaggacataaaagtaaggggagagaaatcaaaaggagaggaggtgagggatactccaataattga

SEQ ID NO: 817 - DNA, 349 bp, Homo sapiens
tagcactgagtaatactccatcgtcttgatgtatcacggtttatctagtcacctactgtcatctactgaaggacatcttggttgctttcaagctctggcaattattaatagaggtggtataaacattttgtacaggttttttgttttgttttgtcttaagacggagtcttactctgtctcccaggctggggtgcagtgccgtgatctcagctcactgcaacctccgcctcctgggttcaagtgattctcctggctcagcctcccgagtaggtgggattacaggtgagcaccaccacacctggctaatttttgtatttttagtagagaaggggtttccccatgttggcca

SEQ ID NO: 818 - DNA, 422 bp, Homo sapiens
gcgtgagcactgactgagcagtgtctacatttttatgtactattcgtctcttcctttctctctgtcttcttccctcctccaatgttagaaatccttgtcagcttaattccttcatacacttttttattttttggtaatgaaatcttagggttagaaggggcctttaaggaatcaggccaaattctcatccaatcagattaagggaactttaaaccaaaagtagagggagaaaggtagggcctaagttggaaaacatagtaaagcagtggtccagtaatttgcaggagaaaacaatcagaaagggccgggcgtggtggctcacgcctataatcccagcactttgggaggccgaggcaggtggatcacttgagctcaggaattcgagaccagcctgcgcaacatggtgaaactcagtctctata

SEQ ID NO: 819 - DNA, 4342 bp, Homo sapiens
gcggggccttctaaggccgaaagtcttcggagcttgcggcagtctcttcgcggcgtccaccacttagacgcaagttgctgaagccggccggggagaaggtgttgttgccggagctgagaccgggcggccacagtccgcagggatgaacctcgagttgctggagtcctttgggcagaactatccagaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaagattttggtcctaaaaacagattctcaggatcttgttgcttccttcagagtgacaactggaacaagcaataccacagccattaagtcaattgagtttgcccggaaggggagttgctttttaattaacacggcagatcgaataatcagagtttatgatggcagagaaatcttaacatgtggaagagatggagagcctgaacctatgcaggaattgcaggatttggtgaataggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagcttggcatcctgttcgacccatcatagcatccatttccagtggagtggtatctatctgggcacagaatcaagtagaaaactggagtgcatttgcaccagacttcaaagaattggatgaaaatgtagaatacgaagaaagggaatcagggtttgatattgaagatgaagataagagtgagcctgagcagacaggggctgatgctgcagaagatgaggaagtggatgtcaccagcgtggaccctattgctgccttctgtagcagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatgaagtccatccactactgggtgtgaagggggatggcaaatccaagaagaagcaagcaggccggcctaaaggatcaaaaggtaaagagaaagattctccatttaaaccgaaactctacaaaggggacagaggtttacctctggaaggatcagcgaagggtaaagtgcaggcggaactcagccagcccttgacagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttggactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttatataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtggtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcactgtcatgagttagaccagtggttgagattagtagatggctcactagacatgtttttgttttgcagacattatatccattccagtcctctgcactgtacactgcagcagtgtgcaaactatgggacttagagggtttctgccatctttccatgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaaaatctgtagttttgtacaagatgagacttagccttgggtacttcttgctgaagctttaatgctttgtaaataaaatcggatgttt

SEQ ID NO: 820 - DNA, 4333 bp, Homo sapiens
gcggggccttctaaggccgaaagtcttcggagcttgcggcagtctcttcgcggcgtccaccacttagacgcaagttgctgaagccggccggggagaaggtgttgttgccggagctgagaccgggcggccacagtccgcagggatgaacctcgagttgctggagtcctttgggcagaactatccagaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaagattttggtcctaaaaacagattctcaggatcttgttgcttccttcagagtgacaactggaacaagcaataccacagccattaagtcaattgagtttgcccggaaggggagttgctttttaattaacacggcagatcgaataatcagagtttatgatggcagagaaatcttaacatgtggaagagatggagagcctgaacctatgcaggaattgcaggatttggtgaataggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagcttggcatcctgttcgacccatcatagcatccatttccagtggagtggtatctatctgggcacagaatcaagtagaaaactggagtgcatttgcaccagacttcaaagaattggatgaaaatgtagaatacgaagaaagggaatcagggtttgatattgaagatgaagataagagtgagcctgagcagacaggggctgatgctgcagaagatgaggaagtggatgtcaccagcgtggaccctattgctgccttctgtagcagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatgaagtccatccactactgggtgtgaagggggatggcaaatccaagaagaagcaagcaggccggcctaaaggatcaaaaggtaaagagaaagattctccatttaaaccgaaactctacaaaggggacagaggtttacctctggaaggatcagcgaagggtaaagtgcaggcggaactcagccagcccttgacagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttggactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttatataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtggtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccatgtgtgaagtagcttggtttcctctgcctgtgcatttggatgtttgtgctatgtccacctcctaaactggctactgagaaaatcatcttcagccctttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaaaatctgtagttttgtacaagatgagacttagccttgggtacttcttgctgaagctttaatgctttgtaaataaaatcggatgttt

SEQ ID NO: 821 - DNA, 4370 bp, Homo sapiens
gcggggccttctaaggccgaaagtcttcggagcttgcggcagtctcttcgcggcgtccaccacttagacgcaagttgctgaagccggccggggagaaggtgttgttgccggagctgagaccgggcggccacagtccgcagggatgaacctcgagttgctgggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaagattttggtcctaaaaacagattctcaggatcttgttgcttccttcagagtgacaactggaacaagcaataccacagccattaagtcaattgagtttgcccggaaggggagttgctttttaattaacacggcagatcgaataatcagagtttatgatggcagagaaatcttaacatgtggaagagatggagagcctgaacctatgcaggaattgcaggatttggtgaataggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagcttggcatcctgttcgacccatcatagcatccatttccagtggagtggtatctatctgggcacagaatcaagtagaaaactggagtgcatttgcaccagacttcaaagaattggatgaaaatgtagaatacgaagaaagggaatcagggtttgatattgaagatgaagataagagtgagcctgagcagacaggggctgatgctgcagaagatgaggaagtggatgtcaccagcgtggaccctattgctgccttctgtagcagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatgaagtccatccactactgggtgtgaagggggatggcaaatccaagaagaagcaagcaggccggcctaaaggatcaaaaggtaaagagaaagattctccatttaaaccgaaactctacaaaggggacagaggtttacctctggaaggatcagcgaagggtaaagtgcaggcggaactcagccagcccttgacagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttggactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttatataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtggtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccatgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaaaatctgtagttttgtacaagatgagacttagccttgggtacttcttgctgaagctttaatgctttgtaaataaaatcggatgttt

SEQ ID NO: 822 - DNA, 3829 bp, Homo sapiens
gcggggccttctaaggccgaaagtcttcggagcttgcggcagtctcttcgcggcgtccaccacttagacgcaagttgctgaagccggccggggagaaggtgttgttgccggagctgagaccgggcggccacagtccgcagggatgaacctcgagttgctggagtcctttgggcagaactatccagaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaagattttggtcctaaaaacagattctcaggatcttgttgcttccttcagagtgacaactggaacaagcaataccacagccattaagtcaattgagtttgcccggaaggggagttgctttttaattaacacggcagatcgaataatcagagtttatgatggcagagaaatcttaacatgtggaagagatggagagcctgaacctatgcaggaattgcaggatttggtgaataggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagcttggcatcctgttcgacccatcatagcatccatttccagtggagtggtatctatctgggcacagaatcaagtagaaaactggagtgcatttgcaccagacttcaaagaattggatgaaaatgtagaatacgaagaaagggaatcagggtttgatattgaagatgaagataagagtgagcctgagcagacaggggctgatgctgcagaagatgaggaagtggatgtcaccagcgtggaccctattgctgccttctgtagcagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatgaagtccatccactactgggtgtgaagggggatggcaaatccaagaagaagcaagcaggccggcctaaaggatcaaaaggtaaagagaaagattctccatttaaaccgaaactctacaaaggggacagaggtttacctctggaaggatcagcgaagggtaaagtgcaggcggaactcagccagcccttgacagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttggactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccatgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaaaatctgtagttttgtacaagatgagacttagccttgggtacttcttgctgaagctttaatgctttgtaaataaaatcggatgttt

SEQ ID NO: 823 - DNA, 2036 bp, Homo sapiens
atggtcagccggtacctctccacactggacattcaggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttatataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtggtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccatgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaaaatctgtagttttgtacaagatgagacttagccttgggtacttcttgctgaagctttaatgctttgtaaataaaatcggatgttt

SEQ ID NO: 824 - DNA, 742 bp, Homo sapiens
gcggggccttctaaggccgaaagtcttcggagcttgcggcagtctcttcgcggcgtccaccacttagacgcaagttgctgaagccggccggggagaaggtgttgttgccggagctgagaccgggcggccacagtccgcagggatgaacctcgagttgctggagtcctttgggcagaactatccagaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaagattttggtcctaaaaacagattctcaggatcttgttgcttccttcagagtgacgttcctcatcccaagatcctgctaa

SEQ ID NO: 825 - DNA, 4396 bp, Homo sapiens
gcggggccttctaaggccgaaagtcttcggagcttgcggcagtctcttcgcggcgtccaccacttagacgcaagttgctgaagccggccggggagaaggtgttgttgccggagctgagaccgggcggccacagtccgcagggatgaacctcgagttgctggagtcctttgggcagaactatccagaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaagattttggtcctaaaaacagattctcaggatcttgttgcttccttcagagtgacaactggaacaagcaataccacagccattaagtcaattgagtttgcccggaaggggagttgctttttaattaacacggcagatcgaataatcagagtttatgatggcagagaaatcttaacatgtggaagagatggagagcctgaacctatgcaggaattgcaggatttggtgaataggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagcttggcatcctgttcgacccatcatagcatccatttccagtggagtggtatctatctgggcacagaatcaagtagaaaactggagtgcatttgcaccagacttcaaagaattggatgaaaatgtagaatacgaagaaagggaatcagggtttgatattgaagatgaagataagagtgagcctgagcagacaggggctgatgctgcagaagatgaggaagtggatgtcaccagcgtggaccctattgctgccttctgtagcagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatgaagtccatccactactgggtgtgaagggggatggcaaatccaagaagaagcaagcaggccggcctaaaggatcaaaaggtaaagagaaagattctccatttaaaccgaaactctacaaaggggacagaggtttacctctggaaggatcagcgaagggtaaagtgcaggcggaactcagccagcccttgacagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttggactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttatataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtggtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccatgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaaaatctgtagttttgtacaagatgagacttagccttgggtacttcttgctgaagctttaatgctttgtaaataaaatcggatgttt

SEQ ID NO: 826 - DNA, 4282 bp, Homo sapiens
gcggggccttctaaggccgaaagtcttcggagcttgcggcagtctcttcgcggcgtccaccacttagacgcaagttgctgaagccggccggggagaaggtgttgttgccggagctgagaccgggcggccacagtccgcagggatgaacctcgagttgctggagtcctttgggcagaactatccagaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaagattttggtcctaaaaacagattctcaggatcttgttgcttccttcagagtgacaactggaacaagcaataccacagccattaagtcaattgagtttgcccggaaggggagttgctttttaattaacacggcagatcgaataatcagagtttatgatggcagagaaatcttaacatgtggaagagatggagagcctgaacctatgcaggaattgcaggatttggtgaataggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagcttggcatcctgttcgacccatcatagcatccatttccagtggagtggtatctatctgggcacagaatcaagtagaaaactggagtgcatttgcaccagacttcaaagaattggatgaaaatgtagaatacgaagaaagggaatcagggtttgatattgaagatgaagataagagtgagcctgagcagacaggggctgatgctgcagaagatgaggaagtggatgtcaccagcgtggaccctattgctgccttctgtagcagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatgaagtccatccactactgggtgtgaagggggatggcaaatccaagaagaagcaagcaggccggcctaaaggatcaaaagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttggactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttatataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtggtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccatgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaaaatctgtagttttgtacaagatgagacttagccttgggtacttcttgctgaagctttaatgctttgtaaataaaatcggatgttt

SEQ ID NO: 827 - DNA, 3505 bp, Homo sapiens
tctagaggatcccgtgtccatcccccttcgtggggatggggaatacatcgtggcaggttctgcccggcagcatgccctgtacatctgggagaagagcattggcaacctggtgaagattctccatgggacgagaggagaactcctcttggatgtagcttggcatcctgttcgacccatcatagcatccatttccagtggagtggtatctatctgggcacagaatcaagtagaaaactggagtgcatttgcaccagacttcaaagaattggatgaaaatgtagaatacgaagaaagggaatcagggtttgatattgaagatgaagataagagtgagcctgagcagacaggggctgatgctgcagaagatgaggaagtggatgtcaccagcgtggaccctattgctgccttctgtagcagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatgaagtccatccactactgggtgtgaagggggatggcaaatccaagaagaagcaagcaggccggcctaaaggatcaaaaggtaaagagaaagattctccatttaaaccgaaactctacaaaggggacagaggtttacctctggaaggatcagcgaagggtaaagtgcaggcggaactcagccagcccttgacagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttggactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttatataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtggtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccatgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaaaatctgtagttttgtacaagatgagacttagccttgggtacttcttgctgaagctttaatgctttgtaaataaaatcggatgttt

SEQ ID NO: 828 - DNA, 416 bp, Homo sapiens
tgaacttgagaacagatagactgttctgtcatggtatttcccaaggcatttggggtaagactggggacatgttgcatggcctacaaagctgtaccacatctggcccctgcctccccttcagttccaccccataccctcttcctcttgccagggacatgttcttctctacatccttctcctagctagctcttgctcagtctttaggtctcagctcaaaaccatccttgatccccaatctaatttaagccccttgttatacattttttttaattgagatgaaattcacataacagaaaattaaccattttaaagtacataattcagggtggcatttagtacactcagattgttgtacaactaccatttctatttagttcgagaatgttttcatcacaccaaaataaaaccatataccc

SEQ ID NO: 829 - DNA, 427 bp, Homo sapiens
gagctggggtcaaccggtactttagtggacaatgagaagtactgagggcaattcacacaacctgtctgtcggtaaacacaagcctaggtaataaccagcttctgcaaagatgaataaacaaaagtcaatcggtggagagtatgcaaaaaattactgcataatgagaggaaggaaatgtctttctaaaaggaagaagctacctttaaaaaatattcactgtgtgtcccagaagaaaaacaatggaaatttgtcttgtgtgctacatagaacatatacaaaggggataatttcaataaaataggagcagaagtttctaagaacagtgtagacagagattaaaaaacaaaagcaaaactatgattgcaatgacagaatttaaatccccagtgggggtggttaaagtgcagcagtgaccttgcaggaaacc

SEQ ID NO: 830 - DNA, 740 bp, Homo sapiens
tatttttagtagagacgggtttcaccgtgttagctaggatggtctcgatctcctgaccttgtggtccgcccacctcagcctcccaaagtgctgggattacaggcgtgagccaccgcacccggccttcattcactttctttaaatgcctccaagttgattattctcctagctcatatctccttgatgtgcatgagggagcactgggtctaatttttgggggctgagaaggtaagaaggtgaggtcagtttttcccaggagtcctaaaaaattctggtaccttacattgagggtgtgggagaaagggtgtcatagttctgaaaataggcagtagcatgaagcaccagacctgtctcattccttattagatgtctatctcaaatgacagagtttgaaaaatattggttttatcatttgatatttccatgcctgactcgggaaaataacattttctgacttttttctattttcttgccctgcacagaccctacctggtacaattttctatttcttagctcaaagtgtctatacaatgggttgcctggtatgtcagctgccctcactcttgtgtaatagaaatatattgccaggctggggacgtggaggagacgaactggattcctccctcctcctgttgccaggcctctctgcattggcactttatcctttcagtgtttctggctgtgttgggttcatttgtgagactgatgtaacaataaagtgaaatcttcccctctgaaag

SEQ ID NO: 831 - DNA, 451 bp, Homo sapiens
gacattcttagtcatttgcacctcctgtcaggtggaccaccagcctgaggctatggagtaaaatggagacaattcgcaaagtgttcctgtctccaagttctatagctgcagtgtagttaaatcccacatcgctgagtatgatggggtctataacctgcatgtttcatgtaaggaacacagccatgtaggtagcactactgtcagaaatacaactggggcactccgagccagtatgagagggagacaaatatcatgcaagatcatcttagggaagtgtccatactcataccaattcttggctaagtcttcttggtttattaccactgaaaatttgtttggtttagttgattatgctgtgaagcataatatgtactacaattttctgtggctttctaacgatcaagataaattccaaaacatcaagtgtagctcctaggctatgacatacgca

SEQ ID NO: 832 - DNA, 370 bp, Homo sapiens
taatgtaacatccagaaaagaggactaatgaaagaatagggcctaaagctaatcagtataactaagaaagaaaagaaggctactttggggaataaaatttctctttaggcaccatcatgtatccactcagatctttttactcatctcactttccccatccagacttcgaaaaattccccatcttccatctatccagtaaactccctttgtcctggggagacccccactccttcagccactttcaagcacattcatcttcacctcaccccattttctacacacatccctgcatcatctctgaaccttacatcatgtaacattttacccacttcagccttctttctacaaccagttagagcctcttaatctt

SEQ ID NO: 833 - DNA, 463 bp, Homo sapiens
gagcttcctggtgatggtggtgattctggaaaacccactagggacgagatgcgtgctaaagttgaatgagctgatggatatgaaccatcagtccaagaatctgtttaaagttcagacttaaaacagtagcaaataagaagtcctatttgtgaaaaacaaacaagaaacaacaatgaaagagcaaaattagcctggtgtggtggtgcatgcctgtaatcctagctactcaggaggctgaggcacgagaattacttgaacccgggagacagaggttgcagtgagccaagattgcaccattgcactccagcctgtgcaacagagtgagactctacaaaaagaagaaaaaaaaaataagtatccgggcttggtggcatgtgcctgtagtctcagctactctgaaggctgagatgggaggatggcttgaggccaggagtaatttgaggctgcagtgaactatgattgt

SEQ ID NO: 834 - DNA, 462 bp, Homo sapiens
tgacaacatctactgagctctttctttgtgccagtcactggggaatttgctttctccacatattatttcattcactcttctttatttattgatttatttatttttagacacagggcctcagtctgttgcccaggctggagtgcagtggcatgatcatggctgactgcagccttgaactcctaggctatagcaattcttccacctcagcctcctcagtagctaggactacagatacacgccactgtgcctgtctaattttaaaaatatatatatttgtagagatggggtctcagtatgttgctcaggctggtctcaaactcctgggcttaagcattcctcccacctcatcctcccaaagtaatgggattacaggtgtgaggcaccgcaccttgctttcatttaattttcacaataaacttacaggttaagtactattgttgtttccattttatagatggagaa

SEQ ID NO: 835 - DNA, 443 bp, Homo sapiens
cccccactcagtctttttttcttcctgtttttccattttctgccaccttgctattgatataccttaggctcttcttctcaccatcctctttaactggacttaaaaccacagactgtcggcaccagaagactctaaaagaatgtatacacttttagataaataacatgccccagatcacagctactcagcagcagaccacaggcagcattcagccctcctgactcccagggtctcacatcctagtctctctctctttcagagttttaattcttgaaggtgatagctctcacatttcccagagaataacccaaagtacaccgtctgtctcactaattctagaataaaaagtaagatttgagacagcttaactgaaatgaatacaccatcatatcaaaattttaaattagagctatattaattattaaaatactatgccgaaatcg

SEQ ID NO: 836 - DNA, 692 bp, Homo sapiens
aaagacaggaaagaggattccaagcagtggggattgtatgtgcaaagatcctacagtgaaagagagggtggcacttaggaagaactgattgtttttccttgtggtcaaggtagagttctggaatacagtgagaaacaaggctgaaggagtagacagtatttacattatagacattttcctaagccgtccattctctgtccttacttagttgagtttctgatgctaaatcctgaatctcagtgcactggtaggctcatctagcctaaattcccacttaatgggtaaaaagaatttcaactggggccccatcccaatctcaaaactgttatagctaaaaactgctccttactcagtacttaatatgtaccaggcagtgtagtaagcctttaaagagatgaattcactcctctaatcattcgtttacatgctggaatatgatcttgctttaaactgccagtctgtcgatcagggtcatatatttcagggacctaaatcagctcccttgttaccacagtccctggattccctgctgcctgtgctctgattaaggagactccagcagctctgcaataaggattgagttgattaacatctggttgaaaatctcttcgcccatatgaacctgagacaaagccatccaaagagtaattgatggcaaagacccgaagttgtctctaagatggcaactcgag

SEQ ID NO: 837 - DNA, 436 bp, Homo sapiens
agccctgtttgcggggttcctcccacacaggcaagtgaaacagccagcacagggacatctgatgccttcttcatattaggaaagtctggaagtggcctcaactccatccgtgagggattgcttcgatgattatgttgtggtttttcttactgaagtgcttattgagatgataattttccgatggaaagaaaagcctgggcttggcgtggtggctcatgcctcgggaggctgaggcgggtggattacctgaggtcaggagtttgagaccagcttgaccaacatggtgaaatccatctctattaaaaatacaaaaattagctgggcatggtggtgggcgcctgtaatcccagctactcgggaggctgaggcaggagaattgcttgaacctgagaggtggaggttgcagtgagctgagattgtgccattgcactcaaac

SEQ ID NO: 838 - DNA, 340 bp, Homo sapiens
gctccgactagtaagctgttgagagggtggacagggcataagtaaggagatatgtccgctgctctttgagccacctggacttgatgctacttcttaggagtgccatgcttaagtgtagacctggaagggaattccaagcagggtgccatagagactatggggtggggccctaagtcaaccaagaatatatgggatgttcagaaggtctcccagacggacaaagccctaatgtgcctattcgtaggggaaagatgcgcaaacgacaaggggacctgtaggagagaaaatcttcagctcctattaaggaaaaacactcattcgaagcacagctggcatcatg

SEQ ID NO: 839 - DNA, 380 bp, Homo sapiens
attcacctgtgcaagctctcagctcacttgtctacctctgcagctcaactttccaggctgctctttgttagtaaatgatttggggctgcttttcatgaggtaaaaagtgtgactgaggattcccaaacccttgctatctccctaagtgatttctttttaacttctatatcaaagagactggagatttttttttatgagaactgcatattgcctctttggtttggtttgttttaaaggcaggttatctgtggaaaccttatttatatattaatttgtttctcttactggagctgaaaaactttttaaggagggatactgtactatttaaatacctttctaaagtcccctaactcccagctttaaacacagctggtttccca

SEQ ID NO: 840 - DNA, 166 bp, Homo sapiens
gaaattgaaattgtatgaaaagtaatcaacttaaacaacatttaatattagcatactgtgactctagaaatgtttatttcgaaaacattttaccccaaaaactgttaagtgagcaagttccatatgttttgtcttagattttaggatagctttaccttaaggttaa

SEQ ID NO: 841 - DNA, 410 bp, Homo sapiens
ttttttttttgtagaaacagggtcttcctatgttgcccaggctggtctcaaactcctggcctcaaatgatcctcctgcctcgacctcccaaagtgctaggattacaagtgtgagtcaacacacctggccaaaatgccatgtctttaaaccagtgtccttctccctataatacctctcactggtcatgtatttccagaaacatactggtgagagggcaggtgttgagaacatggcacttctcacccatcataggaaggagtccaggagttaagagccacggttcctcagggagcttcctcacatggaaggtcagacatatagttagagtctccagataaccatagtcctcagagggagtaagaaggaatcatctctattaatattttgtctcccaaagcattcaaagggcc

SEQ ID NO: 842 - DNA, 343 bp, Homo sapiens
cagggtcctgacaggtgacactgcgtgtggagcgtcagcagggctagccatggacccaggggggtgagagactctccagcgtcatcttggtgagagtgatgttgggatcagagtggaaacaagacagagaggatgcggcagcaaagccataagtgaaagtcactaggaacggtcactttcggcatcagtgaaaatggtctccatggccgcagcacattgtggggacaggcagagtggagtcagcagagggaggaggcatgtggggcgttcagggagccgggcacagctccagagtcctccctgggggactccaggccacgctccctccccagcagctgtgggg

SEQ ID NO: 843 - DNA, 417 bp, Homo sapiens
agcactctatgtttgctgaggcacttctttaatgctcagtcaggttaaactcatccttggctttcacaccttgcttgtgggtagtgtcaaaatcagacacaggtgagaaaatagagctttctcaggcctttcctgaacaagtatgcgtccctgcacatgtgcttagtcttctagattccaggaatatgccaaagcttttcagatctccctggatatctcattacacaggttttcttttcaaatgtttgttcaatcacttgttttttgctgattcgttttactgttctaaacagtgagggtgttaaataattgcctggaatcatttttaacaaacacctggggagggcatttttactgagtaaggtctgactatggtcaaataaggcaagtctcaaataagttttttcagggagttac

SEQ ID NO: 844 - DNA, 439 bp, Homo sapiens
ttcatgtcacccattatatttggtctccacgatgtgtatgttctgaggttttctgctttcaatgcctgggacacgcctgaagatgaggagaaaccagaaggaaggcatgtgcaccagaatggacttcttgagtgctcgctgtttgcctagcatggggttcttaaattatcaggtgcatcagaatcacccaagagacttgttaaacatgagattctgggctccatcctgagtttctgactcagtaggcctgcgatggggcttgaaagtttgcatttgtaagtccccagatgctgctgctgctgctgttggcccagaacacacttggaaagcctctggttcagcccagggctgggcactctggcctgtccagggccagcatggggcaggaccccttcgtgggctggcaggagccctgcacaccctccacacagagcaggct

SEQ ID NO: 845 - DNA, 484 bp, Homo sapiens
gtacaattcacataagtaaagtgtgctattgaatggcttttaatatattcacagacttttacatcgtgaccacaatatatgttagaacatttttatttcaaaagaagccctacacccctcagctatcaccccggcaattgttccatctccctcaaccccacccagttctaggtcaccattaattcactttctgtctctatggagttgctcactccaagcatttatatgtaaatggaatcatgcagtatgctatcctttgagactggcttccttcagttacaaggttcatcctatacttacgcttgaaacatttattaatcacccttttctgcaaccaaaaatgtatgtgaatcgaaattgtaaagtgttctttatttcctgccaccaaaagactttaggaatttaaagtattttctgggtcatgattacaatggttgttatcatgcaacttatgaaaacaacataaatgttataaacgttgcta

SEQ ID NO: 846 - DNA, 354 bp, Homo sapiens
gctgatacctctagttaaccaggtgactggtgagagagcatgttctaagaagagatgggcagatggtgccacctcaagggtaaaacagagctctacctggcagattgaaagctgtcaggaccaatggagcctcaagttcagataaatgaatggggataccaccagggagcagatcctaggggacttgagcaaggttgaggaccctggacctcactttaatgacaggaagaaccacagcaggattttaagcaggtgtgttaatctcctagggccactgtaacaaattaaccacaaaccaagtggcttaatacaacagaaaagcattttctaatagtcctgagggccagaagtctg

SEQ ID NO: 847 - DNA, 491 bp, Homo sapiens
gcccagctagcacctggcacctactccacacccagcatctgcccctgcatgtacctgccctcaccttggccccagcctggccccttgtagcttctgactgaccttgtaaagaacaaactcctccagggccttttctttacaagtttaatacttttgagtgtagtcagtgtaaaagttacaagtacattttagcagaaacttagagggccaggcacagtggttcacacctgtaatcgcagcactttgggaggccaaggtgggtagattgcttgagtccaggagttcaagaccagcctgagcaacatggccagaccccatctctacaataaaatacagaaattacctgggcatggtggtgtgcacctgtagtcccagctgttagggaggctgatgtgggaggatcacttgagcctaggaggttgaggctgcagtgagctggcctctgcatgccactgcactctagcctgggtgacagagcaagaccctgtctc

SEQ ID NO: 848 - DNA, 285 bp, Homo sapiens
acataactcagaactcaggtattcaaggaaaggaagacaagttggataatggaatcactgcttgtcactcacagattgtgatgtcttttcttttagatagacagacagatggatagacgaaagatagatagataggtagatagatggatggatagatgaaaggtaagtaggtaaatagatagacagatagatgcctcctaccaaaagatttccatactggattgagaagtatttaaatatgaggggtctccctgcaaggtatcagattctgtgaagaaatccccc

SEQ ID NO: 849 - DNA, 252 bp, Homo sapiens
atgaactgttttttaatatatgatataccaaacaaaacatatcagcatattgagaaagctaaaagtagaatcaggaaataagaaaacagagaatgccagcttggcgtggtggtgcactcctatagtcccagctactcgggaggctcaggcaggaggatcacttgagcccaggagtttgaggctgttgtgcataatgcttgcccctatgaatagtcactgcactccagcctgggcaacacagaccccatacta

SEQ ID NO: 850 - DNA, 1039 bp, Homo sapiens
atgaaagaaaggagattcagctgtaaattgattaggttaagtaaacattgtagccctggatttatttaaaggtattaatttgaaccatatgaaattgctgtttctctagtcaaaaaccattgaatcttggcagcttaatagggttcagcataatgccagcatgacccattaatgtattttgtctcttagaaaattgtgtatttcctggttctgtccattgaaatgttctagaaacaagagccagtcctgtagcaatttgcatgcttcttggttcttggacccagatttgagtgaccagtgttacctggtgtgcccagacttcccagtttcagcacccgaatttcacatcccaggaaactcttcagtttcaggaaaaccaggatgattggccaccttcacccagattatggtacctaattatcattttcccatgaaaatgaactagggcctttgggacagttggctgattccatacctggggcatggaatgcattaaaataagccttgagtatcttattttaccacagaacaagaaagctatcaaaaagacttaacatgatggtacgaacaggactcaggagccactctgaagaggttccctctggccaaaaataagacaattggaacatcaataagaataacaacttcagtagattgaaacacatcagttgtgctcagttcatgcgttcataatgtactaaaaacaaatttaaaaactcactggtcatctctagagaatgcttgggagctaactcattattttgaaaaacgataaagaaagagaagaatcaaatgctgcttttcctatataaattgaacctcagagtaaccacattgttgatgaggggcagtttatctttatgtgaagattgtagttagtaaagaaggaatgatagactaaaccactttgcaaacccttgatgaacttatggctctagacaatgatcttcagtggcactgacatcatgaaaagaaaagcaaccaggcatcgtatgccacctaagggaagtatacaaacactacttggggagtattattg

SEQ ID NO: 851 - DNA, 365 bp, Homo sapiens
gcgcaatagcagatttcaacccagtgacaagacccaagtgttactagatgccctgggatccctatctacagcctggtcctttctttgagacgggcctccctcccagactcacaggtgacccagtaccttgcccaattccatctagtctagggacacactcctgccccaggcagcatgaatcaatctgtctttctcagtaacagaaacagagacccatggaaatggtcactgcattgtgttggacttcctaagtccaagaccttgcatgtgaagccagtattggcttcgtagcaaccaccagccttaggaaggtaaaattaggtttgagtcaaaattaagagtcttccaggggaagctgattggaa

SEQ ID NO: 852 - DNA, 386 bp, Homo sapiens
gtcttgctactgcttcatttcctatttctgtgctctttgtcctccagaatcaaatttaaaaaattttatttaacgagtgggcagtaaggtaggcaggtcttggaaaaatttaacaccgaaaatagatacaagatactcagaattaacagtattttatcaccatttatttgcacataagaagggaacattttagagaacgcaaaaagtcatatagttttgcttaatcatctgttttcattttaaggaagaacatgtgtccactgggttgacaacaaggtagaagcccatggtaattgcattttagaacaaagaggtgaaccttggagtagatttaacttggctcctttgaactgataacgtcatagtgtagaagatagtgctaaatg

SEQ ID NO: 853 - DNA, 279 bp, Homo sapiens
tttaagtgggtctttctgtttttcttcgtttttgatattttcggccgcatcagcatttatttgcacataagaagggaacattttagagaacgcaaaaagtcatatagttttgcttaatcatctgttttcattttaaggaagaacatgtgtccactgggttgacaacaaggtagaagcccatggtaattgcattttagaacaaagaggtgaaccttggagtagatttaacttggctcctttgaactgataacgtcatagtgtagaagatagtgctaaatg

SEQ ID NO: 854 - DNA, 330 bp, Homo sapiens
gctcattaggatcgggatcgccgaatctcaggcactcacctcagactgactgacttagaatctggatttttaggcaagatccccaggtgattcctaggcattttgaagtctgagagacactggactagtagttttccaacatcacatatgctaacagaacagacgcctgggcccagaatttatggacgtgggccttcaacgtgtgtatttttaatatgcttctgggttatttctaatgcacagagtgtggataactatccaaataaatgcttagaagtgtactttaatatatgagattaaaatcagaattgcaaaattttaaattagaac

SEQ ID NO: 855 - DNA, 321 bp, Homo sapiens
aaaaaaatcgtgacaggtatatcctaggcggccaacaccattggcccggggcactgtctacactgtgcgcttgcgggccacgtcggtgtctgctgagcggtggctgctccaggagcccgcgcccgtcaggcgcaagtgggagggcgcgtgcacacgcatggaccagtcctccaggtccacggggtacgcacaggcacgggatggcacctgtgcacgggtgtgtgcgtgcggcggggcccccacgtgcaagaatctggcgggcgcggttggcttccggagggaggggcccacctagagagcagaccagggacccgagaggcc

SEQ ID NO: 856 - DNA, 376 bp, Homo sapiens
agaagaaataacaaagatcagagcagaactaaatgaaagagagacaacagaaaatcaacaaaatgaaaagttggttctttgaaaagataaacaaactgataaatcattagtagactatccaagaaaagaagagagaagatccaaataaacataatcagaaatgagaaaggagacatgaaaactgaaaccaaagaaacacgaaagatcatcagagactattttggacaaccatatgctcacaaactagaaaacagagaaaaaatggataaattcctgaaaacacacaacctcctaagactgaaccaagaagaaatagaactcttgaacaggtcaataataagtagtggattgagtaagtaatttaacatctcctcat

SEQ ID NO: 857 - DNA, 444 bp, Homo sapiens
tttaaacaataaacattgtaatttaagatggttcttttgattgtaagacaataaacatttgtgaccatgcaagaaaaaaaaaattcaaattgctggatcatgttacagaaagaaaccagatacactgagacaaatactacatgaccttacacatatgtggaatctaataaaaacagacagtgaagccttcatgcaactggtcttagcaatcagtttttggatataacatcaaaggcttgggaaataaaaatacgaacatacacatagtactacaacactgtatccaaactattccaagaacatttaaagcgggactttaggcgggcatggtggctcacgcctgtaatcccagcactttgggaggccaaggcgggtggatcacgagatcaggagatcaagagcatcctggctaacactgtgaaaccccatctctactaaaaatcc

SEQ ID NO: 858 - DNA, 434 bp, Homo sapiens
tctcaacaagtttttaccaatactgttcttgtggtaggatctggtggctttgaaaacatcttatgttaggtatgagctgcaacccagcaaaacaaagcaaaacaaaacaagctcattttcctagttagttttttaaatttttggctctgccatttaataatctttaacaagttacaaaaccttagttttctcatccttaaggaggggaataataaatgtgacagaatagggtagtggtttagagcatggactctgtgtgaaagctctgcatttcccacttactagttccgtgactttaagcagttacttttctttttctttcttttttttttttagatggagtcttgctctgttgcccaggctggagtgcagtggtgcagttttggctcactgcaacccctgcaacctccacctcccaggttcaagcctcttga

SEQ ID NO: 859 - DNA, 418 bp, Homo sapiens
aaccactgctcatggccctggcatatggccctgactcatgctttgctgtatacttgtgcattgccactgatgtatccagcttctctttttcctaattatagggccttgaatttttccaatttgttatgtctcatacttctatttcagctgtaggaaatacactaaatctagcttttttactccaacatatcagatatccctacccgctttgtattatctgtacattttgaaatatgccttttctttgtccaagtgactcagatactgagtaaggcagggtcaggcagaggggctgctgtagactgcccttcaggttcatgtcacccttcagtcattactcagcagaaatttgggaagccagctttcctttcgtagggtctgcttacctggttgtttattgaaatccaaatactacatc

SEQ ID NO: 860 - DNA, 422 bp, Homo sapiens
tgtctccataattgtgcttaggactctggtgcataagtggataaactgttaaacaggatcctaggggagctagggtgacaaagttcaagtccattaaaactagcaacatacattccttactgctcacgcatgactcatggtcttaagatgtttacagttaagaaaagcagcttaatcatacctgcaaggacaaactcctacataaacacaatgtccagatgacccaatatcccatgacaatgtatgcttctaagctaattacagtcatgctttcacgtacttgcacactaaaataccaaggataggtgtttttttttttttgatggagcttcacttttgtcatccaggctggagtgcaataggacaatctcggctcattgcaacttccaccttccgggttcaagcgattctcctgcctcagc

SEQ ID NO: 861 - DNA, 286 bp, Homo sapiens
ccattatcaaaaaaattcaaaattcttccagtttatcatttgattttttaaatgattgatttaataggtgatactactctgtccccaaggtaatacagttacatggtttgaagtgtgaaaggtacaaaggagtatccaataagaagtttcccctcgcccaccttctgttctctagtcaccagctttcctctctgaaagcagccgatattactgtcacccaggctggagtgcagtggcgcaatctcagctcactgcaacctccacctcctgggttcaagagattctc

SEQ ID NO: 862 - DNA, 325 bp, Homo sapiens
aacttttgaagccattctgatgcaggacagtggagcttagtccgcaactgttcttggctttgtccagcagagaattcaaggacaagctggtggtagggtagaagaaaacagttgtatcgaggcagcagtgttaacagctctggcagtgttacaactcttgtgactgctcctgcagagagcagggctaccccataggcagtgtgctgagagtagcagttcagggcaggtctgcaatcacatttacacctacttttttgtttgtttgttttgttttgttttgttttgtttcagatggagttctctctgtcgcccaggctagagtcca

SEQ ID NO: 863 - DNA, 357 bp, Homo sapiens
ctacctgggccagtctcattttttccctgaaccttcattacccatctataagaaaggggctgcaacactgacagctgacaaccgtccccgcctcatggggttagggtagaactggacaagacggatgcctgtgactggccaggagacagtgtccgggagaagctggaagggtttgggtgattactggttactaaaaagagtaaaagtagatgtatgaaaacatgacagtttcctctgagtggtagaattatgggtaattttctttttttctctgtagtatttaaaaaatgtttccaagtatgtatttttatagtcatactaaaaatgactgttacttaaaatttctttaaaaaaaaa

SEQ ID NO: 864 - DNA, 1019 bp, Homo sapiens
cgcggtggctcaagcctgtagtcccaggactttgggaggctgaggcaggtggatcacttgaggtcaagagcctggccaacatggcaaaaccccgtctctactaaaaatagaaaaaaaatcagcctcctgagtagctgggattacaggcctacacaaccacactcagcattttgggaggccaaggtaggaggatcagttgagcccaggagtttgagactagcatgagcaacatagtgagacctcatttctacaaaaaaattagctgggcatggtggcacatgcctgtagtcccagctactcaggaggctgaaggggaagaattgcttgagcccaggaggtcagggctgcagttagccctgatcgtaccactgcactccagcctaggtgacagaatgagacactgtctcaaaaaataaataaaaatatatgctcttcaggccaggcacggtgactcacgcctgtaatcccagcactttgggaggccgaggcaggcggatcacaaggtcagcagttcaagaccagcctgatcaacatggtgaaaccccgtctctactaaaaatagaaaaaaaattagctagacttgggaggctgaggcaggagaattgcttgaaaccggaaggtggaggttgcagtgagctgagattgcgccactgcactctagcctaagcaataagagcaaaattccatctcaaaaataaatagatacataaattaagcactcttcattattttttaattacttaaagactaaattgaagcacttctatttcccattatttgccatgtgaaatcaagtaaaactttttttttcctgggtattgtagcacgggctaaaatgtataaatgtacataaagtcattttctttcagttttatatttacagacttcagatttcttctgtttggtacctaaactaataatcccatgtcttattgatgctgtctttactaagatcagaaatgttgaaatcatcccattttctccctcaaatacagttgtagtttgtaccaaaaaaaaaa

SEQ ID NO: 865 - DNA, 805 bp, Homo sapiens
ctcattagccataacttgagcacatggccttatcaggttataagggagacaaggaaatgtgtctctggctaagtgaaatttttattattaaagaaaataaggagtggttagcagataaaaaacagcagtctctgccacaatagttcactctcatagagggagaaacgtttcatccgtacataaaagggagagtattggaagttttcatggagtgtttgtggtaaaatctagatttcaaggaattgagtgaaggagtgaagattacagagtgggtgaacgtggcttttgagaagtatggtgtccatgaaagaagaggtgattctgggatgttagtggagttaaagaataaattctttttaggtagcagaatctggagcagataatagtctcagaaaaggaatatcttagaaggggagaaactgaaaaccagtacatagcatatttttagatggtatgagggcactgaattaatatagaaagtggataacactttctactccaaacacagggaaaagaggagaggtaaggttgaaatataaacattatgcaatggagaagaaaaaaatcaagaaaaatttaatgatgtcctcattttgaagtcaaaggccagccagatactcttctgagaaggaaagtgtggcagctgtgtaattgagggcagctactgaaggaaatatgatgttagtgaactagaaacacaaaaatagtgagtattttgagggtcagctgaagatagcttggatttatagtaaaattattagtatatgttttgatttttctctaacaaattatggcagcccatatg

SEQ ID NO: 866 - DNA, 571 bp, Homo sapiens
gaaaatcatccccacagtgggtagttcctctctgccactggtcttcctaatgttctccctgagtctggggtttttttgacatcagacaggagaaagtatgcactcattgggtcataggtggccatgagcaggcacagaaaaggcaacacatgttcccactctggtccataggactggtggcccagcccacgggcttcaggccctccttgatcagaaggtggagcttcaccagtgaccctcaccttcctgtccaggattctgtctgcctcccaccaccaaccatggagcccaggtcacttgtaccaaggagcatccaaagaccagtgctgatcagtccgcaacacccctcagcctccctcctacactcatcaaggcccaaagtccagagggttcaagacagcagtgggatggtgcaccagcactgacccgagtgtgcacagacccacctgggctgcgacagcatctgggcttgaccacaaccacactccaaaattagagcaggtgccatgagagatgaggcagtgagagcggacacccccaagctgcaggagaaggggggatctcctggacc

SEQ ID NO: 867 - DNA, 420 bp, Homo sapiens
gggcttgatgaataccaagccaaaacaccttcagggcctgtgaccttcttcagtgaaggaagtacgtctcattaacctgtgcttccctatacactggcccagaggaaagcctttgattgcatattgaaagaagggtcaggtgcagtggctcatgcctataatcccaacactttgagaggccaaggtaggtggattatctaaggtcaggagttcgagaccagcctggccgatatggtgaaaccccgtctctaccaaaaatacaaaaattagccgggcatggtagtgcatgcccataattccagctaaggaggctgaggcaggagaattgcttgaacccgggcagtggaggttgcagtgagccaagatcgcaccagtgcactctagcctgggcgacagagagagactccatctcaaaaaagg

SEQ ID NO: 868 - DNA, 285 bp, Homo sapiens
agaaggaagaggatataacaagtagaaaacagctacaaacatggtgaatattaaactgcaatgggtagggaagtcctcctgggcctgggaaccaaagggtggaagcaggggtggcctatatcaataatcactttaaaggtgaatggtctcaagagaatgagatgacaagccacagactgggaggaaatatttggaattctgtacttttagctcagttttactgaaaacctaaaattgctctaacaaagtctatttttaaaatatttttgaaatgtgactagccta

SEQ ID NO: 869 - DNA, 473 bp, Homo sapiens
gcaatttatacctttcttattttcatatattcaggtttgatatgttgaggatttcatgcaagaggatgatgtggtcaaatgtatgttttaggttactttggcaactctatttaggatggaagggagtgagcttggaagcagggagttgagaggccattgctgcagtataaggggtaagaaaatgagtacccgctgggcgtgttggctcacgcctgtaatcccagcactttgggaggccgaggtgggcggatcacctaaggtcgggagttcgagaccagcctgaccaacatggagaaaccccatctctagtaaaaatgcaaaattagctggttgtggtggcacatgcctataatcccagctacttgggaggctgaggcagaattgcttaaaccctggaggtggaggttgaggtgagccaagattgcgctattgcactccagcccgggcaagaagagtgaaactccgcctcaaaa

SEQ ID NO: 870 - DNA, 342 bp, Homo sapiens
catttaagaaaatgctggcttatctgataagtggggaaaaaagtgtcaagaaaaaaatgctcattagatgcaaggagtgcttccaattaggtagttaaatatgctgaatcctgtaaatctttgtatagcaacacatggcagattataactgctgggatgacccttacatatagtgaatatgaaatagtcaaacagtaaagtcctagctaggtggctgggtggcactccgttttaagtaatttttaaaaccaaccacaatatccccactgggaaatttgctacacagaaagtggccactgtttacagccattggtcactctccaacccaacaactcatttatt

SEQ ID NO: 871 - DNA, 481 bp, Homo sapiens
acattagctcatatattttgtcactttgtaaatataagattgcctatcgagttcagttgaggtagaaataactacgtctgcaaaaagctcatgatcattctcacttataagtgggagctaaacgatgagaactcataaacacaaagaaggaaacaacaggcactgaggtctacttgagggtggagggtgggaggagggagaggagcagaaaagatagctattgggtactgggcttaatacctcagtgatgaaataatctgtacaacaaaccctcatgacacaagttcacctatgtaacaaaccttcacctatgtaacaaacctaaaggggtacctttaggtttaggtacccctgagcctaaaataaaagtttaaaaaaaaagaaaagctcatgattgccaagcagtcactcaggatgtgggttccatctcttcatgaataataggaatgctgtgcttttaaggatcaccccctgccccctc

SEQ ID NO: 872 - DNA, 231 bp, Homo sapiens
agcccaccctggtctttgtcgtgtgaaagggcagtgagagggaggcaagggggatcgccctcctgccaagactctacccatcaggaaattccccaaaaaggatgcttctcaggatggaggcaggggctggagacccaccaatatcacacatgtgcaatctaggctgtttgattttaaagtcctttttaaaaattttcttttgagacagagtctcactctgtcgcccacgct

SEQ ID NO: 873 - DNA, 411 bp, Homo sapiens
tgagacagagtcccactctgtcacccaggctggagtgcagtggtgcaatcttggctcactgcaacctccacctcccaggttcaagcgattctcgtgtctcagcctccccagtagctgggactacaggtgcgccatgacgcctggctaatttttttgtattttcagtagagacggggtttcaccatgttggccagtctgctttcctcctaacctcaagtgagccgcctgcctcgaagatgctttatttataagcgctttggacacactttaataaatgctctattgtatacagttgaactctatataacattttgaataatattgttaatgcttaccctaagtactactatcatctctgtattgtttaacaaaatatttccacatttgacaataaagtcagtatttgaaagg

SEQ ID NO: 874 - DNA, 404 bp, Homo sapiens
ccgcttgtatcatggagtgtcagcttgctggaagccgaatgaattccgcgatgatatgtgcagaaaagagatccagggctttttcgattgtgcttcaagggattaggaagcctaaaaaatgagatcaatacaggagaccctgggagagtctgggagtttacctcccaataaatagagtaagttgtcatagaggtttcctaagacacctcacctaagcttaaaatggaaaagcattttcaatgatttctggactatagcttctgacaattatgcagaggcattttatagatgtttgcattgctgtgacctctttgaaggataagatgaggaaaaacactttttctaacctttggaatcaatagtatgggtagaagttatgttttatcttgaaataaaatcctctg

SEQ ID NO: 875 - DNA, 515 bp, Homo sapiens
gattgctgggggcttcagacaatgatttgtctgaagattgtgggaaccaggtttgggagtgggcaggattcaaggtgctcaaggggcaggaggtgggaggcacttaggacataattgaaacagttattcagtgtgcctgcctgcccgccccctcccagtcccccaccactgccagagagttttgctcttgttgcccaggctggagtgcaatggcacgatctgggctcactgcaacctccgcctcccgggttcaagagattggcctgcctcagcttcccaagtagctgggattatagacgcccgccaccaggcccagctaattttttgtatttttagtagatacggggtttcgccatgttgccaggctggtgattttgggttttttttttttttgcttgttttttttaagtgtcgtggtctcactctgtggcctgggcgggtatacagtggcgcaatcatagctcactgcaacctccaattcctgggtttaagtgaccctcctgagtcagcctccc

SEQ ID NO: 876 - DNA, 3016 bp, Homo sapiens
caacgagttgtagccgcggagagcaggcgtcgatgctggcgcccaaagcctccagcctgagagtcgcctcactcgtgtgacgacagagtttcactcctgttacccaggctggaggacaatgatgtgatctcgggtcaccacaacctccgcctcccggattcaagcgattctcatgcctcagcctcccgagtagctcagattacaggcatgtgccaccacgcccggctaattttgtattttcagtcgagacggggtttccccatgttggtcaggctagtcttgaattcccgacctcaggtgatctgttcgcctcggcctcccaaagtgctgggattacaggcgtgaaccactgcacccggcgaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaattgcgtgatagtttgtagtttcaaccactcttggtgactgtcatcctgtttcttccatattctctgatttcatgaattgaaaagaaacaaatgtattgaagaagtgagctacagttttccttccttaaccatgggtgctagtaactttttaaaactcaagacaagattagttttttatgtgtgaagtcattaaattattacacgaccagaactaaaatgcaatatacagttaagtccacggatactcccattaatgagaaataacactaggaagccactattacaggaagaaaagatttggttttcatggcagtctgtttttttaaaaaaaaatttttgagccactatctattgttgaatattttaagatgggatgagggaggaactaataagggcttacacaataaaaaataactatatcataactcattcataacttgatgtttcattttctgttgaggaaccataaattcattcacagacttaatatttttttcttagagatggtctcgttctgttgtccaggatggagtgcagtggttgatcatagctcccgggccgtagtctcccaggctcgagcaatcctcccacttcaccctcctgcatagctaggactacaggcatgtggcaccatgcccgctaagtttttaaatttcttgtagagatgagatctcgctatgttgcccaggccagtctcaaactcctggactcaagcaatcctcccaccttggccttccaaatcactgggattataggcatgagccattatgcctgactcttgcccaaatttctgatgtcaaattgttcattgacagaaaacccactgaagtatttaaagttaggaagatctgggagataggggttgctggcatgaaaatgtataacttacaacatttattaataaaatgataaattagcatc

SEQ ID NO: 877 - DNA, 494 bp, Homo sapiens
tttagagtatttagaacatgaagtgtgaagctttgggctatatgaatcgtaatagctcttctctttttgatttttgaatgcagtgaattgagatggttactcaaggaatgattgtttacattgttaggtgaggcgtttgattttattcttttttctttctttctttcttttttagacagagtttcactcctgttacccaggctggaggacaatgatgtgatctcgggtcaccacaacctccgcctcccggattcaagcgattctcatgcctcagcctcccgagtagctcagattacaggcatgtgccaccacgcccggctaattttgtatttcccgtctgtactaaaaatacaaaaaattagccgggcgcctgttgtcccagctacttgggaggctgaggcaggagaatggcatgaacccgggaggcggagcttgcagtgagccaagatagcgccactgcactccagcctgggcgaaagagcgagactctgtcc

SEQ ID NO: 878 - DNA, 3201 bp, Homo sapiens
gcccctgaggtgcgcggcgcaggcgcggagcgtggcggccagggcagtgcggccgcggagcctaggccaggggcctggcgctcagggcgtggggcgcgcggggagggagaggggtcggcccagcacagcgtccgggagcgctagggccggagcagcgctgcccgccgccgtgcgtccgcgggaaggaccgcgcggcccctccgcctgcgctctcggccgccgccgcctctgcgtgggccggccgggagggcctcgggggactgactgacagagtttcactcctgttacccaggctggaggacaatgatgtgatctcgggtcaccacaacctccgcctcccggattcaagcgattctcatgcctcagcctcccgagtagctcagattacaggcatgtgccaccacgcccggctaattttgtattttcagtcgagacggggtttccccatgttggtcaggctagtcttgaattcccgacctcaggtgatctgttcgcctcggcctcccaaagtgctgggattacaggcgtgaaccactgcacccggcgaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaattgcgtgatagtttgtagtttcaaccactcttggtgactgtcatcctgtttcttccatattctctgatttcatgaattgaaaagaaacaaatgtattgaagaagtgagctacagttttccttccttaaccatgggtgctagtaactttttaaaactcaagacaagattagttttttatgtgtgaagtcattaaattattacacgaccagaactaaaatgcaatatacagttaagtccacggatactcccattaatgagaaataacactaggaagccactattacaggaagaaaagatttggttttcatggcagtctgtttttttaaaaaaaaatttttgagccactatctattgttgaatattttaagatgggatgagggaggaactaataagggcttacacaataaaaaataactatatcataactcattcataacttgatgtttcattttctgttgaggaaccataaattcattcacagacttaatatttttttcttagagatggtctcgttctgttgtccaggatggagtgcagtggttgatcatagctcccgggccgtagtctcccaggctcgagcaatcctcccacttcaccctcctgcatagctaggactacaggcatgtggcaccatgcccgctaagtttttaaatttcttgtagagatgagatctcgctatgttgcccaggccagtctcaaactcctggactcaagcaatcctcccaccttggccttccaaatcactgggattataggcatgagccattatgcctgactcttgcccaaatttctgatgtcaaattgttcattgacagaaaacccactgaagtatttaaagttaggaagatctgggagataggggttgctggcatgaaaatgtataacttacaacatttattaataaaatgataaattagcatc

SEQ ID NO: 879 - DNA, 2920 bp, Homo sapiens
gcccctgaggtgcgcggcgcaggcgcggagcgtggcggccagggcagtgcggccgcggagcctaggccaggggcctggcgctcagggcgtggggcgcgcggggagggagaggggtcggcccagcacagcgtccgggagcgctagggccggagcagcgctgcccgccgccgtgcgtccgcgggaaggaccgcgcggcccctccgcctgcgctctcggccgccgccgcctctgcgtgggccggccgggagggcctcgggggactgactggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaattgcgtgatagtttgtagtttcaaccactcttggtgactgtcatcctgtttcttccatattctctgatttcatgaattgaaaagaaacaaatgtattgaagaagtgagctacagttttccttccttaaccatgggtgctagtaactttttaaaactcaagacaagattagttttttatgtgtgaagtcattaaattattacacgaccagaactaaaatgcaatatacagttaagtccacggatactcccattaatgagaaataacactaggaagccactattacaggaagaaaagatttggttttcatggcagtctgtttttttaaaaaaaaatttttgagccactatctattgttgaatattttaagatgggatgagggaggaactaataagggcttacacaataaaaaataactatatcataactcattcataacttgatgtttcattttctgttgaggaaccataaattcattcacagacttaatatttttttcttagagatggtctcgttctgttgtccaggatggagtgcagtggttgatcatagctcccgggccgtagtctcccaggctcgagcaatcctcccacttcaccctcctgcatagctaggactacaggcatgtggcaccatgcccgctaagtttttaaatttcttgtagagatgagatctcgctatgttgcccaggccagtctcaaactcctggactcaagcaatcctcccaccttggccttccaaatcactgggattataggcatgagccattatgcctgactcttgcccaaatttctgatgtcaaattgttcattgacagaaaacccactgaagtatttaaagttaggaagatctgggagataggggttgctggcatgaaaatgtataacttacaacatttattaataaaatgataaattagcatc

SEQ ID NO: 880 - DNA, 2964 bp, Homo sapiens
gcccctgaggtgcgcggcgcaggcgcggagcgtggcggccagggcagtgcggccgcggagcctaggccaggggcctggcgctcagggcgtggggcgcgcggggagggagaggggtcggcccagcacagcgtccgggagcgctagggccggagcagcgctgcccgccgccgtgcgtccgcgggaaggaccgcgcggcccctccgcctgcgctctcggccgccgccgcctctgcgtgggccggccgggagggcctcgggggactgactgtgaattgagatggttactcaaggaatgattgtttacattgttaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaattgcgtgatagtttgtagtttcaaccactcttggtgactgtcatcctgtttcttccatattctctgatttcatgaattgaaaagaaacaaatgtattgaagaagtgagctacagttttccttccttaaccatgggtgctagtaactttttaaaactcaagacaagattagttttttatgtgtgaagtcattaaattattacacgaccagaactaaaatgcaatatacagttaagtccacggatactcccattaatgagaaataacactaggaagccactattacaggaagaaaagatttggttttcatggcagtctgtttttttaaaaaaaaatttttgagccactatctattgttgaatattttaagatgggatgagggaggaactaataagggcttacacaataaaaaataactatatcataactcattcataacttgatgtttcattttctgttgaggaaccataaattcattcacagacttaatatttttttcttagagatggtctcgttctgttgtccaggatggagtgcagtggttgatcatagctcccgggccgtagtctcccaggctcgagcaatcctcccacttcaccctcctgcatagctaggactacaggcatgtggcaccatgcccgctaagtttttaaatttcttgtagagatgagatctcgctatgttgcccaggccagtctcaaactcctggactcaagcaatcctcccaccttggccttccaaatcactgggattataggcatgagccattatgcctgactcttgcccaaatttctgatgtcaaattgttcattgacagaaaacccactgaagtatttaaagttaggaagatctgggagataggggttgctggcatgaaaatgtataacttacaacatttattaataaaatgataaattagcatc

SEQ ID NO: 881 - DNA, 3323 bp, Homo sapiens
gcccctgaggtgcgcggcgcaggcgcggagcgtggcggccagggcagtgcggccgcggagcctaggccaggggcctggcgctcagggcgtggggcgcgcggggagggagaggggtcggcccagcacagcgtccgggagcgctagggccggagcagcgctgcccgccgccgtgcgtccgcgggaaggaccgcgcggcccctccgcctgcgctctcggccgccgccgcctctgcgtgggccggccgggagggcctcgggggactgactgacagagtttcactcctgttacccaggctggaggacaatgatgtgatctcgggtcaccacaacctccgcctcccggattcaagcgattctcatgcctcagcctcccgagtagctcagattacaggcatgtgccaccacgcccggctaattttgtattttcagtcgagacggggtttccccatgttggtcaggctagtcttgaattcccgacctcaggtgatctgttcgcctcggcctcccaaagtgctgggattacaggcgtgaaccactgcacccggcgaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatggagtctcgctttgtcgcccaggctggagtgcagcagcgcgatcttggctcactgcaacctccgcctcccaggttcaagcaattctcctgcctcagcttcctgagtagctggggttacagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaattgcgtgatagtttgtagtttcaaccactcttggtgactgtcatcctgtttcttccatattctctgatttcatgaattgaaaagaaacaaatgtattgaagaagtgagctacagttttccttccttaaccatgggtgctagtaactttttaaaactcaagacaagattagttttttatgtgtgaagtcattaaattattacacgaccagaactaaaatgcaatatacagttaagtccacggatactcccattaatgagaaataacactaggaagccactattacaggaagaaaagatttggttttcatggcagtctgtttttttaaaaaaaaatttttgagccactatctattgttgaatattttaagatgggatgagggaggaactaataagggcttacacaataaaaaataactatatcataactcattcataacttgatgtttcattttctgttgaggaaccataaattcattcacagacttaatatttttttcttagagatggtctcgttctgttgtccaggatggagtgcagtggttgatcatagctcccgggccgtagtctcccaggctcgagcaatcctcccacttcaccctcctgcatagctaggactacaggcatgtggcaccatgcccgctaagtttttaaatttcttgtagagatgagatctcgctatgttgcccaggccagtctcaaactcctggactcaagcaatcctcccaccttggccttccaaatcactgggattataggcatgagccattatgcctgactcttgcccaaatttctgatgtcaaattgttcattgacagaaaacccactgaagtatttaaagttaggaagatctgggagataggggttgctggcatgaaaatgtataacttacaacatttattaataaaatgataaattagcatc

SEQ ID NO: 882 - DNA, 3148 bp, Homo sapiens
gcccctgaggtgcgcggcgcaggcgcggagcgtggcggccagggcagtgcggccgcggagcctaggccaggggcctggcgctcagggcgtggggcgcgcggggagggagaggggtcggcccagcacagcgtccgggagcgctagggccggagcagcgctgcccgccgccgtgcgtccgcgggaaggaccgcgcggcccctccgcctgcgctctcggccgccgccgcctctgcgtgggccggccgggagggcctcgggggactgactgacagagtttcactcctgttacccaggctggaggacaatgatgtgatctcgggtcaccacaacctccgcctcccggattcaagcgattctcatgcctcagcctcccgagtagctcagattacaggcatgtgccaccacgcccggctaattttgtattttcagtcgagacggggtttccccatgttggtcaggctagtcttgaattcccgacctcaggtgatctgttcgcctcggcctcccaaagtgctgggattacaggcgtgaaccactgcacccggcgaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaattgcgtgatagtttgtagtttcaaccactcttggtgactgtcatcctgtttcttccatattctctgatttcatgaattgaaaagaaacaaatgtattgaagaagtgagctacagttttccttccttaaccatgggtgctagtaactttttgaccagaactaaaatgcaatatacagttaagtccacggatactcccattaatgagaaataacactaggaagccactattacaggaagaaaagatttggttttcatggcagtctgtttttttaaaaaaaaatttttgagccactatctattgttgaatattttaagatgggatgagggaggaactaataagggcttacacaataaaaaataactatatcataactcattcataacttgatgtttcattttctgttgaggaaccataaattcattcacagacttaatatttttttcttagagatggtctcgttctgttgtccaggatggagtgcagtggttgatcatagctcccgggccgtagtctcccaggctcgagcaatcctcccacttcaccctcctgcatagctaggactacaggcatgtggcaccatgcccgctaagtttttaaatttcttgtagagatgagatctcgctatgttgcccaggccagtctcaaactcctggactcaagcaatcctcccaccttggccttccaaatcactgggattataggcatgagccattatgcctgactcttgcccaaatttctgatgtcaaattgttcattgacagaaaacccactgaagtatttaaagttaggaagatctgggagataggggttgctggcatgaaaatgtataacttacaacatttattaataaaatgataaattagcatc

SEQ ID NO: 883 - DNA, 2610 bp, Homo sapiens
gcccctgaggtgcgcggcgcaggcgcggagcgtggcggccagggcagtgcggccgcggagcctaggccaggggcctggcgctcagggcgtggggcgcgcggggagggagaggggtcggcccagcacagcgtccgggagcgctagggccggagcagcgctgcccgccgccgtgcgtccgcgggaaggaccgcgcggcccctccgcctgcgctctcggccgccgccgcctctgcgtgggccggccgggagggcctcgggggactgactggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaattgcgtgatagtttgtagtttcaaccactcttggtgactgtcatcctgtttcttccatattctctgatttcatgaattgaaaagaaacaaatgtattgaagaagtgagctacagttttccttccttaaccatgggtgctagtaactttttaaaactcaagacaagattagttttttatgtgtgaagtcattaaattattacacgaccagaactaaaatgcaatatacagttaagtccacggatactcccattaatgagaaataacactaggaagccactattacaggaagaaaagatttggttttcatggcagtctgtttttttaaaaaaaaatttttgagccactatctattgttgaatattttaagatgggatgagggaggaactaataagggcttacacaataaaaaataactatatcataactcattcataacttgatgtttcattttctgttgaggaaccataaattcattcacagacttaatatttttttcttagagatggtctcgttctgttgtccaggatggagtgcagtggttgatcatagctcccgggccgtagtctcccaggctcgagcaatcctcccacttcaccctcctgcatagctaggactacaggcatgtggcaccatgcccgctaagtttttaaatttcttgtagagatgagatctcgctatgttgcccaggccagtctcaaactcctggactcaagcaatcctcccaccttggccttccaaatcactgggattataggcatgagccattatgcctgactcttgcccaaatttctgatgtcaaattgttcattgacagaaaacccactgaagtatttaaagttaggaagatctgggagataggggttgctggcatgaaaatgtataacttacaacatttattaataaaatgataaattagcatc

SEQ ID NO: 884 - DNA, 3147 bp, Homo sapiens
gcccctgaggtgcgcggcgcaggcgcggagcgtggcggccagggcagtgcggccgcggagcctaggccaggggcctggcgctcagggcgtggggcgcgcggggagggagaggggtcggcccagcacagcgtccgggagcgctagggccggagcagcgctgcccgccgccgtgcgtccgcgggaaggaccgcgcggcccctccgcctgcgctctcggccgccgccgcctctgcgtgggccggccgggagggcctcgggggactgactgacagagtttcactcctgttacccaggctggaggacaatgatgtgatctcgggtcaccacaacctccgcctcccggattcaagcgattctcatgcctcagcctcccgagtagctcagattacaggcatgtgccaccacgcccggctaattttgtattttcagtcgagacggggtttccccatgttggtcaggctagtcttgaattcccgacctcaggtgatctgttcgcctcggcctcccaaagtgctgggattacaggcgtgaaccactgcacccggcgaggcattttttactgtctacagaaacttattgtaattcatttttcctcactccagtagtaagaattataccaaattgaaaagatatgaatgagtatcctaaaaaaagaaaaaggaagactctacacccttctcgttattcagattcctctggaataagcagaattgcagatggattcaatggaattttctctgatcattgttacagtgtctgttctatgagacagccagatttaaaatattttgacaacaaagatgatgattctgataccgagacgtcaaatgacttgccaaaatttgcagatggaatcaaggccagaaacagaaatcagaactacctggttcccagtcctgtacttagaattctagaccacactgccttttctacagaaaaatctgctgatattgtaatttgtgatgaagagtgtgactcacctgaatcagtcaaccagcaaacccaagaggagagtcctatagaagttcacactgctgaagatgttccaattgctgtagaagtgcatgcgatttctgaggattatgatatagagacagaaaacaattcctctgagagtctccaagaccaaactgatgaagaaccgccagctaaactttgtaaaattcttgacaagagccaagctttgaatgtgactgcccagcagaaatggcctttactgagagctaatagcagtggcctctataaatgtgaactttgtgagtttaacagcaaatatttttctgacttaaagcagcatatgatcctgaagcataaacgtactgattcaaatgtgtgtcgagtatgcaaggaaagtttctctaccaatatgcttctgatagaacatgccaaactgcatgaagaggatccctacatttgtaaatactgtgattataagacagtaatttttgagaacctcagccagcacattgcagacacccattttagtgatcacctctattggtgtgaacagtgtgatgtacagttctcctcaagcagtgaactctacctacatttccaggagcacagctgtgatgaacagtacttgtgtcagttctgtgaacatgaaactaatgatccagaagacttgcatagccatgtggtaaatgagcatgcatgtaaattaatagagttaagtgataagtataacaatggtgaacatggacagtatagcctcttaagcaaaattacctttgacaaatgtaaaaacttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattattattttcaattgcgtgatagtttgtagtttcaaccactcttggtgactgtcatcctgtttcttccatattctctgatttcatgaattgaaaagaaacaaatgtattgaagaagtgagctacagttttccttccttaaccatgggtgctagtaactttttaaaactcaagacaagattagttttttatgtgtgaagtcattaaattattacacgaccagaactaaaatgcaatatacagttaagtccacggatactcccattaatgagaaataacactaggaagccactattacaggaagaaaagatttggttttcatggcagtctgtttttttaaaaaaaaatttttgagccactatctattgttgaatattttaagatgggatgagggaggaactaataagggcttacacaataaaaaataactatatcataactcattcataacttgatgtttcattttctgttgaggaaccataaattcattcacagacttaatatttttttcttagagatggtctcgttctgttgtccaggatggagtgcagtggttgatcatagctcccgggccgtagtctcccaggctcgagcaatcctcccacttcaccctcctgcatagctaggactacaggcatgtggcaccatgcccgctaagtttttaaatttcttgtagagatgagatctcgctatgttgcccaggccagtctcaaactcctggactcaagcaatcctcccaccttggccttccaaatcactgggattataggcatgagccattatgcctgactcttgcccaaatttctgatgtcaaattgttcattgacagaaaacccactgaagtatttaaagttaggaagatctgggagataggggttgctggcatgaaaatgtataacttacaacatttattaataaaatgataaattagcatc

SEQ ID NO: 885 - DNA, 1523 bp, Homo sapiens
tttgtgtgaaaacccccccccaaaaaaaaaaaatttgttgggtttaaaaaaaaaaaaaaaaaaaccttttctttgtatgtcaagtatgtggttttcggagtagacttcacacaaatgttaacaggcatgttgctattgaacatacaaaaatttttcctcatgtttgtgatgactgtgggaaaggcttttcaagtatgctagaatattgcaagcatttaaattcacatttatctgaagggatttatttatgtcaatattgtgaatattcaacaggacaaattgaagatcttaaaattcatctagatttcaagcattcagctgacttgcctcataaatgtagtgactgcttgatgaggtttggaaatgaaagggaattaataagtcaccttccagtccatgagacaacttgattattctctttaacttacagaatgttagtttaaaataataaattcatcctttttttggagatgattaaatggatgattgtaaacacaacttatgaaatctgcctttaacaagtaacttttttaaattataaaattttattggcattgctccattttctgtatataaatatatctttaatgtggtattttcaattgcgtgatagtttgtagtttcaaccactcttggtgactgtcatcctgtttcttccatattctctgatttcatgaattgaaaagaaacaaatgtattgaagaagtgagctacagttttccttccttaaccatgggtgctagtaactttttaaaactcaagacaagattagttttttatgtgtgaagtcattaaattattacacgaccagaactaaaatgcaatatacagttaagtccacggatactcccattaatgagaaataacactaggaagccactattacaggaagaaaagatttggttttcatggcagtctgtttttttaaaaaaaaatttttgagccactatctattgttgaatattttaagatgggatgagggaggaactaataagggcttacacaataaaaaataactatatcataactcattcataacttgatgtttcattttctgttgaggaaccataaattcattcacagacttaatatttttttcttagagatggtctcgttctgttgtccaggatggagtgcagtggttgatcatagctcccgggccgtagtctcccaggctcgagcaatcctcccacttcaccctcctgcatagctaggactacaggcatgtggcaccatgcccgctaagtttttaaatttcttgtagagatgagatctcgctatgttgcccaggccagtctcaaactcctggactcaagcaatcctcccaccttggccttccaaatcactgggattataggcatgagccattatgcctgactcttgcccaaatttctgatgtcaaattgttcattgacagaaaacccactgaagtatttaaagttaggaagatctgggagataggggttgctggcatgaaaatgtataacttacaacatttattaataaaatgataaattagcatc

SEQ ID NO: 886 - DNA, 299 bp, Homo sapiens
aatcctaaggaacttcaaaaagtgtaatctagtccaaatggggcatcaattctaaagcatttgcttgtttgagcagattttctgtgtctgaggtatatagataacttatctttttatgactaaatccaagtccttagttcctgttggaattcaaaatcatatttaaaaattgatgctttgttctataattaatgctttgattgtataaataataagtattcttccaaatccctttttacagatgatgattctgataccgagacgtcaaatgacttgccaaaatttgcagatggaatcaa

SEQ ID NO: 887 - DNA, 617 bp, Homo sapiens
tacttccaatggtaggaaatgtgcctataaaactcctagtatggtgccataggcacagtgtttctttttttatatatacacaaaataaaatgacttaaacatgtggtttattgtaattatccagttctcacaatttatatcaacatttgaaaaagaattttttaacctccgtaagaaagaaaacagaaatcagtttctgccttgaaacctgactggaaaacaatctgaaatacaaacagaggcatcatttaacacttttcttataccatagattttcaggtggctcacatatttcatattgccaataaattcttcagttagaatttttataacgtcattaacagttgttatttgtgacatatttgttaattttttctcgttttttagattgaaaagatatgaatgagtatcctaaaaaaagaaaaaggaagactctacacccttctcgttattcaggtcagtgtataattattttaaagttgggtatggattaattcccacaaaattatattctcatccattttctcctaagtgatcagataagacttaaatatctgggtcaatatttaggtaaaacaacggtttaaatacattatctgaatatatattccttattg

SEQ ID NO: 888 - DNA, 814 bp, Homo sapiens
atggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacaggtcagtgctctgaagcgtttccccttcccttcctcctcttgaactcccgggcccctcagagggggaccaaggcgacgttttgccgcgatccccctgctccccgaatcctcggcccctcccccagactctcaactcggaaatctctcgccgtcgccgccgcgccc

SEQ ID NO: 889 - DNA, 5769 bp, Homo sapiens
atggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctggtgaatgaagtagactcttcgggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttacctaaagtggacacatgttacttctgaatttcacatgaaaggaaattaaagatggacaataattatctctcaatattttaagatttgttttactaattgaaaacagtatgtcagtaaatctttggccttagtgcttttttcccccttttacacattaataaaatgttttaaatatggtaatactcttaaaacggtagaatttgccacagttgtttaaagcatttttattttttctttgaattcttaattcatggtgaacagatgttgggttcttaaaatataaaaatgagaaaatatgtattaaaaatacttgatagagggttttctctttaatcacaacttaaaaaaagaaacctttaatacctctgcataagttctctgaaagaacttaaattcttagtttatatgaaaactgatatgtatgtctgtgtaacaaagcctgttgggtacaggtctacaaggagatactttgtttctaaaaaaggagttaaatcgtgtcacctgaattttttttttttgagataagtggacattttggggattttggttaaaacatatttctctattctaaaaattacagaatatgtattcataaaagggaagaaattgttagaaaatttcctgtgtacgtagtttgtttttaaattaaagaatcttgtgacctggtgtaggacattttgcatttgtaacactgcagttttaatatatttgctgttttttttaaaattagaatatgtttaaaatttaatggttatgaggctctgtagccttaaaatgttttatagtagtaaaatgtattattttcatcttaaaaaaaactaaatatttacat

SEQ ID NO: 890 - DNA, 5266 bp, Homo sapiens
atggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctggtgaatgaagtagactcttcgggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttaaaaaaaaaaaaaaaaaaaaaaaaaatttggggggggcttgggccctggaaaggtttctacaacccacttcgcgtgtgggcgccgcggggcgccccagtgtggtataggtgcacaacggcgcccaaaaagggtgttcccctcagggaaaacacccgggcgcaacactagaaaagcggccgggggattctccacccgatataaaaagaagcgcgcgggggggaaaccagggcgcttcttgaagcaaactcccagaatgggagggctcccagaagggcaatagcgggcgctcatctacgcggggggccacgaaagcgcgcaataaaattgca

SEQ ID NO: 891 - DNA, 3609 bp, Homo sapiens
atggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctggtgaatgaagtagactcttcgggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttc

SEQ ID NO: 892 - DNA, 5170 bp, Homo sapiens
acttcccgctcgaccctcggttctggacaacggagatcgtccccagtcaagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctggtgaatgaagtagactcttcgggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttacctaaagtggacacatgttacttctgaatttcacatgaaaggaaattaaagatggacaataattatctctcaatattttaagatttgttttactaattgaaaacagtatgtcagtaaatctttggccttagtgcttttttcccccttttacacattaataaaatgttttaaatatggtaatactcttaaaacggtagaatttgccacagttgtttaaagcatttttattttttctttgaattcttaattcatggtgaacagatgttgggttcttaaaatataaaaatgagaaaatatgtattaaaaatacttgatagagggttttctctttaatcacaacttaaaaaaagaaacctttaatacctctgcataagttctctgaaagaacttaaattcttagtttatatgaaaactgatatgtatgtctgtgtaacaaagcctgttgggtacaggtctacaaggagatactttgtttctaaaaaaggagttaaatcgtgtcacctgaattttttttttttgagataagtggacattttggggattttggttaaaacatatttctctattctaaaaattacagaatatgtattcataaaagggaagaaattgttagaaaatttcctgtgtacgtagtttgtttttaaattaaagaatcttgtgacctggtgtaggacattttgcatttgtaacactgcagttttaatatatttgctgttttttttaaaattagaatatgtttaaaatttaatggttatgaggctctgtagccttaaaatgttttatagtagtaaaatgtattattttcatcttaaaaaaaactaaatatttacat

SEQ ID NO: 893 - DNA, 5262 bp, Homo sapiens
acttcccgctcgaccctcggttctggacaacggagatcgtccccagtcaaggtgattatatcgcagatctcacttgggagcttctcttaacctgtgaccatcgcctgagttagctggccgacttcccagcggtcctttgtgagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctggtgaatgaagtagactcttcgggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttacctaaagtggacacatgttacttctgaatttcacatgaaaggaaattaaagatggacaataattatctctcaatattttaagatttgttttactaattgaaaacagtatgtcagtaaatctttggccttagtgcttttttcccccttttacacattaataaaatgttttaaatatggtaatactcttaaaacggtagaatttgccacagttgtttaaagcatttttattttttctttgaattcttaattcatggtgaacagatgttgggttcttaaaatataaaaatgagaaaatatgtattaaaaatacttgatagagggttttctctttaatcacaacttaaaaaaagaaacctttaatacctctgcataagttctctgaaagaacttaaattcttagtttatatgaaaactgatatgtatgtctgtgtaacaaagcctgttgggtacaggtctacaaggagatactttgtttctaaaaaaggagttaaatcgtgtcacctgaattttttttttttgagataagtggacattttggggattttggttaaaacatatttctctattctaaaaattacagaatatgtattcataaaagggaagaaattgttagaaaatttcctgtgtacgtagtttgtttttaaattaaagaatcttgtgacctggtgtaggacattttgcatttgtaacactgcagttttaatatatttgctgttttttttaaaattagaatatgtttaaaatttaatggttatgaggctctgtagccttaaaatgttttatagtagtaaaatgtattattttcatcttaaaaaaaactaaatatttacat

SEQ ID NO: 894 - DNA, 5189 bp, Homo sapiens
aaccggcgactttagaggacccccatcggaacccaatgagccgcatggactcggaggacagcatattttgcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctggtgaatgaagtagactcttcgggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttacctaaagtggacacatgttacttctgaatttcacatgaaaggaaattaaagatggacaataattatctctcaatattttaagatttgttttactaattgaaaacagtatgtcagtaaatctttggccttagtgcttttttcccccttttacacattaataaaatgttttaaatatggtaatactcttaaaacggtagaatttgccacagttgtttaaagcatttttattttttctttgaattcttaattcatggtgaacagatgttgggttcttaaaatataaaaatgagaaaatatgtattaaaaatacttgatagagggttttctctttaatcacaacttaaaaaaagaaacctttaatacctctgcataagttctctgaaagaacttaaattcttagtttatatgaaaactgatatgtatgtctgtgtaacaaagcctgttgggtacaggtctacaaggagatactttgtttctaaaaaaggagttaaatcgtgtcacctgaattttttttttttgagataagtggacattttggggattttggttaaaacatatttctctattctaaaaattacagaatatgtattcataaaagggaagaaattgttagaaaatttcctgtgtacgtagtttgtttttaaattaaagaatcttgtgacctggtgtaggacattttgcatttgtaacactgcagttttaatatatttgctgttttttttaaaattagaatatgtttaaaatttaatggttatgaggctctgtagccttaaaatgttttatagtagtaaaatgtattattttcatcttaaaaaaaactaaatatttacat

SEQ ID NO: 895 - DNA, 5240 bp, Homo sapiens
cctcggcgcttcgctcctcacggacctcaggacggctctaactcggaaacagtccccaaacgggcccagatcctctggcggagcagaagagggccttgatgtacacacgtcggtactcaagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctggtgaatgaagtagactcttcgggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttacctaaagtggacacatgttacttctgaatttcacatgaaaggaaattaaagatggacaataattatctctcaatattttaagatttgttttactaattgaaaacagtatgtcagtaaatctttggccttagtgcttttttcccccttttacacattaataaaatgttttaaatatggtaatactcttaaaacggtagaatttgccacagttgtttaaagcatttttattttttctttgaattcttaattcatggtgaacagatgttgggttcttaaaatataaaaatgagaaaatatgtattaaaaatacttgatagagggttttctctttaatcacaacttaaaaaaagaaacctttaatacctctgcataagttctctgaaagaacttaaattcttagtttatatgaaaactgatatgtatgtctgtgtaacaaagcctgttgggtacaggtctacaaggagatactttgtttctaaaaaaggagttaaatcgtgtcacctgaattttttttttttgagataagtggacattttggggattttggttaaaacatatttctctattctaaaaattacagaatatgtattcataaaagggaagaaattgttagaaaatttcctgtgtacgtagtttgtttttaaattaaagaatcttgtgacctggtgtaggacattttgcatttgtaacactgcagttttaatatatttgctgttttttttaaaattagaatatgtttaaaatttaatggttatgaggctctgtagccttaaaatgttttatagtagtaaaatgtattattttcatcttaaaaaaaactaaatatttacat

SEQ ID NO: 896 - DNA, 4956 bp, Homo sapiens
cggaccttattccttcttattgcatgtagatgtcagcgaggagcggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctggtgaatgaagtagactcttcgggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttacctaaagtggacacatgttacttctgaatttcacatgaaaggaaattaaagatggacaataattatctctcaatattttaagatttgttttactaattgaaaacagtatgtcagtaaatctttggccttagtgcttttttcccccttttacacattaataaaatgttttaaatatggtaatactcttaaaacggtagaatttgccacagttgtttaaagcatttttattttttctttgaattcttaattcatggtgaacagatgttgggttcttaaaatataaaaatgagaaaatatgtattaaaaatacttgatagagggttttctctttaatcacaacttaaaaaaagaaacctttaatacctctgcataagttctctgaaagaacttaaattcttagtttatatgaaaactgatatgtatgtctgtgtaacaaagcctgttgggtacaggtctacaaggagatactttgtttctaaaaaaggagttaaatcgtgtcacctgaattttttttttttgagataagtggacattttggggattttggttaaaacatatttctctattctaaaaattacagaatatgtattcataaaagggaagaaattgttagaaaatttcctgtgtacgtagtttgtttttaaattaaagaatcttgtgacctggtgtaggacattttgcatttgtaacactgcagttttaatatatttgctgttttttttaaaattagaatatgtttaaaatttaatggttatgaggctctgtagccttaaaatgttttatagtagtaaaatgtattattttcatcttaaaaaaaactaaatatttacat

SEQ ID NO: 897 - DNA, 5715 bp, Homo sapiens
atggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctggtgaatgaagtagactcttcgggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttatttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttacctaaagtggacacatgttacttctgaatttcacatgaaaggaaattaaagatggacaataattatctctcaatattttaagatttgttttactaattgaaaacagtatgtcagtaaatctttggccttagtgcttttttcccccttttacacattaataaaatgttttaaatatggtaatactcttaaaacggtagaatttgccacagttgtttaaagcatttttattttttctttgaattcttaattcatggtgaacagatgttgggttcttaaaatataaaaatgagaaaatatgtattaaaaatacttgatagagggttttctctttaatcacaacttaaaaaaagaaacctttaatacctctgcataagttctctgaaagaacttaaattcttagtttatatgaaaactgatatgtatgtctgtgtaacaaagcctgttgggtacaggtctacaaggagatactttgtttctaaaaaaggagttaaatcgtgtcacctgaattttttttttttgagataagtggacattttggggattttggttaaaacatatttctctattctaaaaattacagaatatgtattcataaaagggaagaaattgttagaaaatttcctgtgtacgtagtttgtttttaaattaaagaatcttgtgacctggtgtaggacattttgcatttgtaacactgcagttttaatatatttgctgttttttttaaaattagaatatgtttaaaatttaatggttatgaggctctgtagccttaaaatgttttatagtagtaaaatgtattattttcatcttaaaaaaaactaaatatttacat

SEQ ID NO: 898 - DNA, 5206 bp, Homo sapiens
atggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttacctaaagtggacacatgttacttctgaatttcacatgaaaggaaattaaagatggacaataattatctctcaatattttaagatttgttttactaattgaaaacagtatgtcagtaaatctttggccttagtgcttttttcccccttttacacattaataaaatgttttaaatatggtaatactcttaaaacggtagaatttgccacagttgtttaaagcatttttattttttctttgaattcttaattcatggtgaacagatgttgggttcttaaaatataaaaatgagaaaatatgtattaaaaatacttgatagagggttttctctttaatcacaacttaaaaaaagaaacctttaatacctctgcataagttctctgaaagaacttaaattcttagtttatatgaaaactgatatgtatgtctgtgtaacaaagcctgttgggtacaggtctacaaggagatactttgtttctaaaaaaggagttaaatcgtgtcacctgaattttttttttttgagataagtggacattttggggattttggttaaaacatatttctctattctaaaaattacagaatatgtattcataaaagggaagaaattgttagaaaatttcctgtgtacgtagtttgtttttaaattaaagaatcttgtgacctggtgtaggacattttgcatttgtaacactgcagttttaatatatttgctgttttttttaaaattagaatatgtttaaaatttaatggttatgaggctctgtagccttaaaatgttttatagtagtaaaatgtattattttcatcttaaaaaaaactaaatatttacat

SEQ ID NO: 899 - DNA, 4163 bp, Homo sapiens
ccacgcgtcgcccacgcgtccgataatatttatgcttagtgtaaacattctggtgaatgaagtagactcttcgggtggaatatattaatatattactgtatatccacattttcatggaatggtactgtgggagactgagcaaacactcttttggcaacttagtagaacagcttcttaaaggctttgcatgcttgctgctttaagctgcttttttttttcttttcttccctttagtgatttcagtagtttatattggaaagaaaaacaattacaacatgtgcccttacaaataccaaaagcactgtaaggatatttgtcttgacagtgtttattgatttgaagtcatattaggaaatatttagacaatgaaaattatcaagagataatttacctttcaattatgataaatagatgtgattggttgccatttgtgttcttttgcagaactctgataagaaaagtgttcaatttgtatttaagcaaacagtgaacgacgtttgcaatcaactaaaaattcgtctatcgaattagggctgaaaattactgttaaagagtgttgcagtatgtctggtggctcccttttcaggactagggctttctcatggagtacagtatgttaatatttacctatataactaatctgttaacggtttttgaaaaacctttcaaattatttgaataatcttcatattttcatttaacctatatgactctaattttttttctgaggaaatcatttggtttttgagttgttttttcttaatgtaagaaaaattgtattttttttacaagtatcttcaaactgaatcttttatgcaccaaagttggtcttgaaaaggaaaataaaatcactttcttgcttggtaagcaagaagccatatcgattttttttaacttacagaaatggaaatatgtgtaacttgttagtattgtattaaacaaatgttgcatagagataatagaacattgcttgtaaataattcagcagatttgtaatatatttttatattttgaaatgtactgtagatgttttctagaggcatgaaagttaaatgtatatattatggtagaaataatattgaaggatattgtacttcactagtgctgccagaggaattgttaataaaagcaccttctttaacaataaatgtctttcacagacttaagggactatgtactactgttaatatctctaagaacaaaacacattgaacatccttccagaaagtctttgagggaggacctatacccataatagaattatggcactcatttctgacagtgatcaagaaatcagttatttccttactgttggaaggacattgtaaagtatgtggttatatgcagtgaaactgcagaaaatactcctggttgaggagttttcactttactacagtgatataaaaaccagcagtttttacactaaattttttaaagaaatattagacaaaaatatagaattaaaacctttggttccaaaatgggaaaggttccacgatacataaatcatttctcatttgctttaaaaaatttaaaagtgtaaaaattatgagagactttattcgttaacaatgggggtaaagagctatatacatgaaaatgagtcttataaaattaagtgaagtgcaaataaaagcactgctactataagacattctggaatggttgtttaataagggtattatccatttgatctatagcaatgtgattttatttttaaaaagaaaagcagtgtgttttctttttttgttgttttcttttgcttaagcacttcatcaattgctttattctgtatctgcgaagtaatctgcaatctcttttgttctttttaaaatttgatttgttataaaattgccaaatagaagtgtttcagatacatagtttgtacctgtatttttattttattgcctcatgttcttgtaagtcattcttaattgaccaatgattgtagaccttgcttgagtattttttctaataaaacaaagcaaatcacatttagcttcaaattgtaacaattcaattgaattttaaaatgacacctgaaaagatacatctgatattttctatatagagcacagtaaataagttttttcattgtgtagaaatacttagatgtcaaaaccagatttcgtgatccttgattaacttctgagtactcaatcaatcataatccttttgctgcttatctgatgttggtttgatactgttaacacaccaaaaagaatatggaattgaaatgagctagctttataacttgtatgtatacatatatacacataacatccaattatgactgggtaataagtgtgaaaattttaatttgtggttttcatttattaatgtctgcccatctgtattgttgctcctaccttcaaatatgacacctgaaataataagtctgttgtccagaatttatgtattgttcagcatcaagcaaactacagctcacaagcatacccatttatatgttgtctatgcctgctttctcctgcagtggcagaattgagtggtgagaccttaggtcctgcaagcccccaatttttactacaggttggcaatccctaatccaaaaatctgacataaaaaatgctccaaagttcaaaactttctgagtgctgacatcatgctgcaagtggaaaattccacgcctgacctcatgtgactggtcatagtcaaaacaattaagactttgtttcatgcacaaaattattaaaactgttgtataaaattaccttcagtctatgtgtataaggtgtttgtgagatataaatgaactttatgtttagtcttggatcgcatttctgagtctcattatgtatatgcagatactcaaaaatctgaaaaaaatcaaaaatctgaaatacttctggtcccaagcatttcggataagggatactcagcctgtctctggtcctttaagaaaaagttttcgattcctttgtctagttgacaaaaagtttggaaacataaacttagaccacacaacttgcattttaatatgacaatgttgatcttggtaataagccagtacattaaattttagtgaaagctgtttcatgtattttacagtaaatactgccatattaggtacctacaacaaatggtggtttttggaaacttttacggtgggtttttaaagttattaatagtccatcatttcatcatttgtgtttctgtatttattttgctaagaactaaataagattttgtacatcagattgtgtttgaaccgtaaggcacatctgctttatctaaaagaatcttaaggtggaaatagtgtaaaatttaaaattttttatatttctaataaactttttatatataaatgttacctaaagtggacacatgttacttctgaatttcacatgaaaggaaattaaagatggacaataattatctctcaatattttaagatttgttttactaattgaaaacagtatgtcagtaaatctttggccttagtgcttttttcccccttttacacattaataaaatgttttaaatatggtaatactcttaaaacggtagaatttgccacagttgtttaaagcatttttattttttctttgaattcttaattcatggtgaacagatgttgggttcttaaaatataaaaatgagaaaatatgtattaaaaatacttgatagagggttttctctttaatcacaacttaaaaaaagaaacctttaatacctctgcataagttctctgaaagaacttaaattcttagtttatatgaaaactgatatgtatgtctgtgtaacaaagcctgttgggtacaggtctacaaggagatactttgtttctaaaaaaggagttaaatcgtgtcacctgaattttttttttttgagataagtggacattttggggattttggttaaaacatatttctctattctaaaaattacagaatatgtattcataaaagggaagaaattgttagaaaatttcctgtgtacgtagtttgtttttaaattaaagaatcttgtgacctggtgtaggacattttgcatttgtaacactgcagttttaatatatttgctgttttttttaaaattagaatatgtttaaaatttaatggttatgaggctctgtagccttaaaatgttttatagtagtaaaatgtattattttcatcttaaaaaaaactaaatatttacat

SEQ ID NO: 900 - DNA, 2268 bp, Homo sapiens
atggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagaggttgaagaggtaaaaaataaataaatacataaaaagcaaacaagcggggacacctgcagtcttagtcactgacaatgggtttagggaaagttgcacattagagtcaaccccttcttttttttttttttttttttaaatccagtatttaggataatatttatgcttagtgtaaacattctggtgaatgaagtagactcttcgggtggaatatattaatatattactgtatatccacattttcatggaatggtactgtgggagactgagcaaacactctttgtagggacaatcttaagttagaaacaggtctttcttaagaggctcttgtggcagtggctgtgcgcggcgctttaaagcgcgtggcttatattatttttctcttttctcttccctcctttagtgtgtatttcacacgataagtttttattattgtggaaaagagaacaaaccaattatacgaagcatgtgtgtcgccctttacaaaattcaccaaaaagagcactgtgtgtagacggattatttgtgctcttgtgcaccgagcgtgtctatacactggcatttgtgaaagtctcattatttgaggaaaactcttgtgtagaacaaagtgcaacaatttttctcacgagaaaggcaatcaaacttaaaccctctttcgcaacatttttgtgacactacaaaatcagacagtggctgaactgcggggttggcccaattgtgggtgataccctatttgcggacaagaaaaacttcgtgtcaattacgacaaaagcggcgtgttcccacactcggg

SEQ ID NO: 901 - DNA, 2237 bp, Homo sapiens
  misc_feature (1523)..(1523): n is a, c, g, or t
  misc_feature (1553)..(1553): n is a, c, g, or t
  misc_feature (1564)..(1564): n is a, c, g, or t
atggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacattctgcctgatgtgtgggtgaatgaaagtgaacgacatcagttaaaaactaaagtagttcatttatcaaagctacccaaagatactgccttgcttttggacccaaacatatacagaacaatgccgcagaagagttgaagagatggagtttcactcttgttgcccaggctggtgtgcantggcgcgatcttggctcaccgaacctccgnttccgggtcangcgattcttctgcctcagcttcctgagtagctgggattaaagacacccgccaccacgcccagctaattttgtattttgagtggagacggggtttcgccatattgaccaggctggtctcaaactcccgacctcaggtgatctgcccgcctcggcctcccaaagtgctgagattacaggcgtgagccaccgtgcccagccaagtttaatttttacaccaatgattcatttctgcttttacaggtgattactttatctcactagaaaaacaaacactgctcaaatcctaaacaaaaagtgtccaaaacttacaaataagccttaatctcgaataattaccatgacattgtgttaccttgtgtgcttattgctgtacaagccttcttttggcttctgaacagagcaactgctgagcagaagcactttcaacctcgtctggtcatttgatgaattctgactcactgtggtgcctatgggtgaagtctattccccctgtttataattttaatggggaagaggccctgtgccaggtctgatttcacaacacacaaacacattaacaaaaaacgtcgacgcttccttccgggcggcgaacaaagtgctccaaggcgccatcgctacgctgtctcgaccccttcttgttcaagggtaaaccggtccccaaagaaggcgaatg

SEQ ID NO: 902 - DNA, 2123 bp, Homo sapiens
  misc_feature (1409)..(1409): n is a, c, g, or t
  misc_feature (1439)..(1439): n is a, c, g, or t
  misc_feature (1450)..(1450): n is a, c, g, or t
atggccgacctggaggagctctcccgcctgagccctctgccccccggcagcccgggttcggcggcgcggggccgggctgagccccccgaggaggaggaggaagaggaggaggaggaagaggaggcggaggccgaggcggtggcggcgctgctgctgaacggcggcagcggtgggggcggcggaggcggcggcggaggagtggggggcggcgaggcagagacgatgtcggagccgagccccgagagcgccagccaggccggggaggacgaagacgaggaggaggacgacgaggaggaggaagatgagagcagcagcagcggcgggggtgaggaggagagtagcgccgagagcctggtgggcagcagcggcgggagcagcagcgacgagacccgctcgttgagccccggcgccgccagcagcagcagcggggatggggacggcaaggagggcctggaggagcccaagggaccgcggggcagccagggcggcggcgggggcggcagcagtagcagcagcgtagtctccagcggcggcgacgagggctacgggactgggggaggcggaagcagcgcgacctccgggggccggcggggcagcttggagatgtcgtcggatggggaacccctgagccgcatggactcggaggacagcataagcagtactataatggatgtagacagcacaatttccagtgggcgttcaactccagcaatgatgaatggacaaggaagcactacttcttcaagcaaaaatattgcctataattgttgttgggaccagtgccaggcttgcttcaactctagcccagatctggcagatcacatccgttccatacatgtagatggtcagcgaggaggggtatttgtttgcttatggaaaggttgtaaagtatataacactccatctaccagtcaaagttggttacaaaggcatatgctgacacacagtggagacaaacctttcaagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattaccacggccacatgatttcttcgatgcacaaacactggatgcgataagacatcgagccatatgctttaacctctcagctcatatagaaagtttagggaagggacacagtgttgtttttcatagtactgtaatagctaagagaaaagaagattctgggaagatcaaacttttgcttcattggatgcctgaagacataacaatgccgcagaagagttgaagagatggagtttcactcttgttgcccaggctggtgtgcantggcgcgatcttggctcaccgaacctccgnttccgggtcangcgattcttctgcctcagcttcctgagtagctgggattaaagacacccgccaccacgcccagctaattttgtattttgagtggagacggggtttcgccatattgaccaggctggtctcaaactcccgacctcaggtgatctgcccgcctcggcctcccaaagtgctgagattacaggcgtgagccaccgtgcccagccaagtttaatttttacaccaatgattcatttctgcttttacaggtgattactttatctcactagaaaaacaaacactgctcaaatcctaaacaaaaagtgtccaaaacttacaaataagccttaatctcgaataattaccatgacattgtgttaccttgtgtgcttattgctgtacaagccttcttttggcttctgaacagagcaactgctgagcagaagcactttcaacctcgtctggtcatttgatgaattctgactcactgtggtgcctatgggtgaagtctattccccctgtttataattttaatggggaagaggccctgtgccaggtctgatttcacaacacacaaacacattaacaaaaaacgtcgacgcttccttccgggcggcgaacaaagtgctccaaggcgccatcgctacgctgtctcgaccccttcttgttcaagggtaaaccggtccccaaagaaggcgaatg

SEQ ID NO: 903 - DNA, 408 bp, Homo sapiens
ctattgatagatatgtatttgttaattgtttccatctttattacttattactgttatgtttttctaaatattctttactttttatgttgacttttagcacggccacatgatttcttcgatgcacaaacactggatgcgataagacatcgagccatatgctttaacctctcagctcatatagaaagtttagggaagggacacagtgttgtttttcatagtactgtaagtattcttttattttttcaaattaaatataaaactttgcaaaaaaatatttccacaatcatttctaaatctctcaaaatctaagaaagtacaatttaacagaaatcacaaaaccttttgttttatcagtatttaaaacattgtattattggttataaagcacacatttcttataattttaca

SEQ ID NO: 904 - DNA, 1035 bp, Homo sapiens
agcgggtattcacgcgccggaagtgcatttgcagagtgagacaaagcggagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcat

SEQ ID NO: 905 - DNA, 794 bp, Homo sapiens
ttggtggcaaggtctgcaagtgcgtccgggacgcaaataaaaccatggctggagtataaagactcctatatagggcgacaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcat

SEQ ID NO: 906 - DNA, 517 bp, Homo sapiens
ggacgcgtgggtcgacccacgcgtctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcat

SEQ ID NO: 907 - DNA, 874 bp, Homo sapiens
agcgggtattcacgcgccggaagtgcatttgcagagtgagacaaagcggagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccaagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcat

SEQ ID NO: 908 - DNA, 594 bp, Homo sapiens
  misc_feature (37)..(37): n is a, c, g, or t
cacacacacatcattcaaaatagcaaaaggaaacaancctttacgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccaagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcat

SEQ ID NO: 909 - DNA, 3052 bp, Homo sapiens
agcgggtattcacgcgccggaagtgcatttgcagagtgagacaaagcggagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaagttgcacaagttccttattttccttaatatttcacttctatttaatacaagctgggacataaaaattctgttggggatacctgggggaagatgtgagaaactaatgctgaattcagcttatacatgatgaaaagaaaaaccagacaaaaggagcacataaatatgcatacagtgtaactgttattattttaatacccacgataagggatttttgttagcatgtttagggggaacgaggattggtgggatccttgggccacaggaatctgaggcaacggaagatatatagagtgatcgtccccctgccgaaggaacctggcatctgtcaagcagatgctgcagttcaaacttcagcttttaagatagatagctattgaaggcagagggtcagcaggaggatgtgtatttctaatctaccctggtaaagtcataggtaagactcaaaagcgggatcttattcaaaaggcaggtatttcctttgttttctgtcttgaaatagccccttcccctaaggtgcattctctcaagttttcagtattgctttatttgcagtgattaaaagagatgagagactttggagacagacaacgtaagcaacacatacacacatgaaatactctagacagagatgaatataaatctggcctaataaccagttttccatgtaacagtgattttgtgtttcgggctgaagcagtggttatattaaaagccactaattcccttatccctttaaaagatttttacaattctccaaccacaaacagcacttctaaaactaactttactttctgcccataatttgttctacatggaaaaaaaaaatattactttggccaggggtgtgtgtaaatgtggcagaattcctaggcaggctgacctttacagtatgggcctttaagatactggatcctggttgggcacagtggctcacgcctgtaatccagcaccgaggccaagaaaattactcaatttcttaagctatattgaagggttttctctgtccttacaggtcaaatgaataatttgtgacacctaggtcagcttgctccatgtcctatttagtaatcaaagaagagtggcactatttatgactaataaattgaaattcaaaaacagccatgaatacaggcaagaaaagtttctctaaataactattctgtaaaagaaatgaagatttcacatacttgaaattactgctcagccagccacataagtagtttccctatgcttgtaagccagatgtttgatcagtatattagtaaataaaaagctgagcttacacaagtatttccttggcacactgaactttctttttgaaacatatcactctgttacccaggctggagtgcagaggtgcaatcctggctcactgcaacctccgcctcctgggttcaaatgatcctcctgccttagccttccgtgttgctgggatcacaggcatgcaccaccatgcccggctaatttttgtatttttagtatagacaggttttcaccatgttggccaggatggtctcgaactcctgacctcaagtgattcacctgccttggcctcccaaagtgctgggattacaggtgtgagccacggcacccggcctgaagtttctgaaaacaaattagaagactgttggcttggctaatctcgtagttcagggccaagtttctgtagtcagaatgaagaataaaattgaaagaaaaagggggaaatgcttatacttggcattaagttgaatgcctcaagtcttaactatggctttgtagatgaggcaaaagatttcttagtggtaaaatttcttcaacaggtcaatgccaatctgtatgccattttagtaaagtaggtaaggagagtagccgctcagtaactttggcactaaagaaagagtgtggctctagaacttccaattccattgctagatgtgccctttaaaagatggtccagtgctttcagggaaggatgtttagccagttttcctagtatttgttccttaagattttttgacctgtgcttaa

SEQ ID NO: 910 - DNA, 2416 bp, Homo sapiens
agcgggtattcacgcgccggaagtgcatttgcagagtgagacaaagcggagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaagttgcacaagttccttattttccttaatatttcacttctatttaatacaagctgggacataaaaattctgttggggatacctgggggaagatgtgagaaactaatgctgaattcagcttatacatgatgaaaagaaaaaccagacaaaaggagcacataaatatgcatacagtgtaactgttattattttaatacccacgataagggatttttgttagcatgtttagggggaacgaggattggtgggatccttgggccacaggaatctgaggcaacggaagatatatagagtgatcgtccccctgccgaaggaacctggcatctgtcaagcagatgctgcagttcaaacttcagcttttaagatagatagctattgaaggcagagggtcagcaggaggatgtgtatttctaatctaccctggtaaagtcataggtaagactcaaaagcgggatcttattcaaaaggcaggtatttcctttgttttctgtcttgaaatagccccttcccctaaggtgcattctctcaagttttcagtattgctttatttgcagtgattaaaagagatgagagactttggagacagacaacgtaagcaacacatacacacatgaaatactctagacagagatgaatataaatctggcctaataaccagttttccatgtaacagtgattttgtgtttcgggctgaagcagtggttatattaaaagccactaattcccttatccctttaaaagatttttacaattctccaaccacaaacagcacttctaaaactaactttactttctgcccataatttgttctacatggaaaaaaaaaatattactttggccaggggtgtgtgtaaatgtggcagaattcctaggcaggctgacctttacagtatgggcctttaagatactggatcctggttgggcacagtggctcacgcctgtaatccagcaccgaggccaagctgaagtttctgaaaacaaattagaagactgttggcttggctaatctcgtagttcagggccaagtttctgtagtcagaatgaagaataaaattgaaagaaaaagggggaaatgcttatacttggcattaagttgaatgcctcaagtcttaactatggctttgtagatgaggcaaaagatttcttagtggtaaaatttcttcaacaggtcaatgccaatctgtatgccattttagtaaagtaggtaaggagagtagccgctcagtaactttggcactaaagaaagagtgtggctctagaacttccaattccattgctagatgtgccctttaaaagatggtccagtgctttcagggaaggatgtttagccagttttcctagtatttgttccttaagattttttgacctgtgcttaa

SEQ ID NO: 911 - DNA, 3078 bp, Homo sapiens
ggctgtactggcccggaattttggtgatccaactttcttgtacaaagttgtgcggtcagctcgcgatgaactatgagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaagttgcacaagttccttattttccttaatatttcacttctatttaatacaagctgggacataaaaattctgttggggatacctgggggaagatgtgagaaactaatgctgaattcagcttatacatgatgaaaagaaaaaccagacaaaaggagcacataaatatgcatacagtgtaactgttattattttaatacccacgataagggatttttgttagcatgtttagggggaacgaggattggtgggatccttgggccacaggaatctgaggcaacggaagatatatagagtgatcgtccccctgccgaaggaacctggcatctgtcaagcagatgctgcagttcaaacttcagcttttaagatagatagctattgaaggcagagggtcagcaggaggatgtgtatttctaatctaccctggtaaagtcataggtaagactcaaaagcgggatcttattcaaaaggcaggtatttcctttgttttctgtcttgaaatagccccttcccctaaggtgcattctctcaagttttcagtattgctttatttgcagtgattaaaagagatgagagactttggagacagacaacgtaagcaacacatacacacatgaaatactctagacagagatgaatataaatctggcctaataaccagttttccatgtaacagtgattttgtgtttcgggctgaagcagtggttatattaaaagccactaattcccttatccctttaaaagatttttacaattctccaaccacaaacagcacttctaaaactaactttactttctgcccataatttgttctacatggaaaaaaaaaatattactttggccaggggtgtgtgtaaatgtggcagaattcctaggcaggctgacctttacagtatgggcctttaagatactggatcctggttgggcacagtggctcacgcctgtaatccagcaccgaggccaagaaaattactcaatttcttaagctatattgaagggttttctctgtccttacaggtcaaatgaataatttgtgacacctaggtcagcttgctccatgtcctatttagtaatcaaagaagagtggcactatttatgactaataaattgaaattcaaaaacagccatgaatacaggcaagaaaagtttctctaaataactattctgtaaaagaaatgaagatttcacatacttgaaattactgctcagccagccacataagtagtttccctatgcttgtaagccagatgtttgatcagtatattagtaaataaaaagctgagcttacacaagtatttccttggcacactgaactttctttttgaaacatatcactctgttacccaggctggagtgcagaggtgcaatcctggctcactgcaacctccgcctcctgggttcaaatgatcctcctgccttagccttccgtgttgctgggatcacaggcatgcaccaccatgcccggctaatttttgtatttttagtatagacaggttttcaccatgttggccaggatggtctcgaactcctgacctcaagtgattcacctgccttggcctcccaaagtgctgggattacaggtgtgagccacggcacccggcctgaagtttctgaaaacaaattagaagactgttggcttggctaatctcgtagttcagggccaagtttctgtagtcagaatgaagaataaaattgaaagaaaaagggggaaatgcttatacttggcattaagttgaatgcctcaagtcttaactatggctttgtagatgaggcaaaagatttcttagtggtaaaatttcttcaacaggtcaatgccaatctgtatgccattttagtaaagtaggtaaggagagtagccgctcagtaactttggcactaaagaaagagtgtggctctagaacttccaattccattgctagatgtgccctttaaaagatggtccagtgctttcagggaaggatgtttagccagttttcctagtatttgttccttaagattttttgacctgtgcttaa

SEQ ID NO: 912 - DNA, 1055 bp, Homo sapiens
agcgggtattcacgcgccggaagtgcatttgcagagtgagacaaagcggagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcatccaacaaaagggcggccgct

SEQ ID NO: 913 - DNA, 3046 bp, Homo sapiens
agctcggtaccctttcccaacgagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcagtttcttggtttggttttttaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaagttgcacaagttccttattttccttaatatttcacttctatttaatacaagctgggacataaaaattctgttggggatacctgggggaagatgtgagaaactaatgctgaattcagcttatacatgatgaaaagaaaaaccagacaaaaggagcacataaatatgcatacagtgtaactgttattattttaatacccacgataagggatttttgttagcatgtttagggggaacgaggattggtgggatccttgggccacaggaatctgaggcaacggaagatatatagagtgatcgtccccctgccgaaggaacctggcatctgtcaagcagatgctgcagttcaaacttcagcttttaagatagatagctattgaaggcagagggtcagcaggaggatgtgtatttctaatctaccctggtaaagtcataggtaagactcaaaagcgggatcttattcaaaaggcaggtatttcctttgttttctgtcttgaaatagccccttcccctaaggtgcattctctcaagttttcagtattgctttatttgcagtgattaaaagagatgagagactttggagacagacaacgtaagcaacacatacacacatgaaatactctagacagagatgaatataaatctggcctaataaccagttttccatgtaacagtgattttgtgtttcgggctgaagcagtggttatattaaaagccactaattcccttatccctttaaaagatttttacaattctccaaccacaaacagcacttctaaaactaactttactttctgcccataatttgttctacatggaaaaaaaaaatattactttggccaggggtgtgtgtaaatgtggcagaattcctaggcaggctgacctttacagtatgggcctttaagatactggatcctggttgggcacagtggctcacgcctgtaatccagcaccgaggccaagaaaattactcaatttcttaagctatattgaagggttttctctgtccttacaggtcaaatgaataatttgtgacacctaggtcagcttgctccatgtcctatttagtaatcaaagaagagtggcactatttatgactaataaattgaaattcaaaaacagccatgaatacaggcaagaaaagtttctctaaataactattctgtaaaagaaatgaagatttcacatacttgaaattactgctcagccagccacataagtagtttccctatgcttgtaagccagatgtttgatcagtatattagtaaataaaaagctgagcttacacaagtatttccttggcacactgaactttctttttgaaacatatcactctgttacccaggctggagtgcagaggtgcaatcctggctcactgcaacctccgcctcctgggttcaaatgatcctcctgccttagccttccgtgttgctgggatcacaggcatgcaccaccatgcccggctaatttttgtatttttagtatagacaggttttcaccatgttggccaggatggtctcgaactcctgacctcaagtgattcacctgccttggcctcccaaagtgctgggattacaggtgtgagccacggcacccggcctgaagtttctgaaaacaaattagaagactgttggcttggctaatctcgtagttcagggccaagtttctgtagtcagaatgaagaataaaattgaaagaaaaagggggaaatgcttatacttggcattaagttgaatgcctcaagtcttaactatggctttgtagatgaggcaaaagatttcttagtggtaaaatttcttcaacaggtcaatgccaatctgtatgccattttagtaaagtaggtaaggagagtagccgctcagtaactttggcactaaagaaagagtgtggctctagaacttccaattccattgctagatgtgccctttaaaagatggtccagtgctttcagggaaggatgtttagccagttttcctagtatttgttccttaagattttttgacctgtgcttaa

SEQ ID NO: 914 - DNA, 2769 bp, Homo sapiens
  misc_feature (18)..(18): n is a, c, g, or t
cctctctaacaccctcanatcgaagatgaagtttgctcaacgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaagttgcacaagttccttattttccttaatatttcacttctatttaatacaagctgggacataaaaattctgttggggatacctgggggaagatgtgagaaactaatgctgaattcagcttatacatgatgaaaagaaaaaccagacaaaaggagcacataaatatgcatacagtgtaactgttattattttaatacccacgataagggatttttgttagcatgtttagggggaacgaggattggtgggatccttgggccacaggaatctgaggcaacggaagatatatagagtgatcgtccccctgccgaaggaacctggcatctgtcaagcagatgctgcagttcaaacttcagcttttaagatagatagctattgaaggcagagggtcagcaggaggatgtgtatttctaatctaccctggtaaagtcataggtaagactcaaaagcgggatcttattcaaaaggcaggtatttcctttgttttctgtcttgaaatagccccttcccctaaggtgcattctctcaagttttcagtattgctttatttgcagtgattaaaagagatgagagactttggagacagacaacgtaagcaacacatacacacatgaaatactctagacagagatgaatataaatctggcctaataaccagttttccatgtaacagtgattttgtgtttcgggctgaagcagtggttatattaaaagccactaattcccttatccctttaaaagatttttacaattctccaaccacaaacagcacttctaaaactaactttactttctgcccataatttgttctacatggaaaaaaaaaatattactttggccaggggtgtgtgtaaatgtggcagaattcctaggcaggctgacctttacagtatgggcctttaagatactggatcctggttgggcacagtggctcacgcctgtaatccagcaccgaggccaagaaaattactcaatttcttaagctatattgaagggttttctctgtccttacaggtcaaatgaataatttgtgacacctaggtcagcttgctccatgtcctatttagtaatcaaagaagagtggcactatttatgactaataaattgaaattcaaaaacagccatgaatacaggcaagaaaagtttctctaaataactattctgtaaaagaaatgaagatttcacatacttgaaattactgctcagccagccacataagtagtttccctatgcttgtaagccagatgtttgatcagtatattagtaaataaaaagctgagcttacacaagtatttccttggcacactgaactttctttttgaaacatatcactctgttacccaggctggagtgcagaggtgcaatcctggctcactgcaacctccgcctcctgggttcaaatgatcctcctgccttagccttccgtgttgctgggatcacaggcatgcaccaccatgcccggctaatttttgtatttttagtatagacaggttttcaccatgttggccaggatggtctcgaactcctgacctcaagtgattcacctgccttggcctcccaaagtgctgggattacaggtgtgagccacggcacccggcctgaagtttctgaaaacaaattagaagactgttggcttggctaatctcgtagttcagggccaagtttctgtagtcagaatgaagaataaaattgaaagaaaaagggggaaatgcttatacttggcattaagttgaatgcctcaagtcttaactatggctttgtagatgaggcaaaagatttcttagtggtaaaatttcttcaacaggtcaatgccaatctgtatgccattttagtaaagtaggtaaggagagtagccgctcagtaactttggcactaaagaaagagtgtggctctagaacttccaattccattgctagatgtgccctttaaaagatggtccagtgctttcagggaaggatgtttagccagttttcctagtatttgttccttaagattttttgacctgtgcttaa

SEQ ID NO: 915 - DNA, 2770 bp, Homo sapiens
cgtttttctccactccccctccccaaacaaccccccttaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaagttgcacaagttccttattttccttaatatttcacttctatttaatacaagctgggacataaaaattctgttggggatacctgggggaagatgtgagaaactaatgctgaattcagcttatacatgatgaaaagaaaaaccagacaaaaggagcacataaatatgcatacagtgtaactgttattattttaatacccacgataagggatttttgttagcatgtttagggggaacgaggattggtgggatccttgggccacaggaatctgaggcaacggaagatatatagagtgatcgtccccctgccgaaggaacctggcatctgtcaagcagatgctgcagttcaaacttcagcttttaagatagatagctattgaaggcagagggtcagcaggaggatgtgtatttctaatctaccctggtaaagtcataggtaagactcaaaagcgggatcttattcaaaaggcaggtatttcctttgttttctgtcttgaaatagccccttcccctaaggtgcattctctcaagttttcagtattgctttatttgcagtgattaaaagagatgagagactttggagacagacaacgtaagcaacacatacacacatgaaatactctagacagagatgaatataaatctggcctaataaccagttttccatgtaacagtgattttgtgtttcgggctgaagcagtggttatattaaaagccactaattcccttatccctttaaaagatttttacaattctccaaccacaaacagcacttctaaaactaactttactttctgcccataatttgttctacatggaaaaaaaaaatattactttggccaggggtgtgtgtaaatgtggcagaattcctaggcaggctgacctttacagtatgggcctttaagatactggatcctggttgggcacagtggctcacgcctgtaatccagcaccgaggccaagaaaattactcaatttcttaagctatattgaagggttttctctgtccttacaggtcaaatgaataatttgtgacacctaggtcagcttgctccatgtcctatttagtaatcaaagaagagtggcactatttatgactaataaattgaaattcaaaaacagccatgaatacaggcaagaaaagtttctctaaataactattctgtaaaagaaatgaagatttcacatacttgaaattactgctcagccagccacataagtagtttccctatgcttgtaagccagatgtttgatcagtatattagtaaataaaaagctgagcttacacaagtatttccttggcacactgaactttctttttgaaacatatcactctgttacccaggctggagtgcagaggtgcaatcctggctcactgcaacctccgcctcctgggttcaaatgatcctcctgccttagccttccgtgttgctgggatcacaggcatgcaccaccatgcccggctaatttttgtatttttagtatagacaggttttcaccatgttggccaggatggtctcgaactcctgacctcaagtgattcacctgccttggcctcccaaagtgctgggattacaggtgtgagccacggcacccggcctgaagtttctgaaaacaaattagaagactgttggcttggctaatctcgtagttcagggccaagtttctgtagtcagaatgaagaataaaattgaaagaaaaagggggaaatgcttatacttggcattaagttgaatgcctcaagtcttaactatggctttgtagatgaggcaaaagatttcttagtggtaaaatttcttcaacaggtcaatgccaatctgtatgccattttagtaaagtaggtaaggagagtagccgctcagtaactttggcactaaagaaagagtgtggctctagaacttccaattccattgctagatgtgccctttaaaagatggtccagtgctttcagggaaggatgtttagccagttttcctagtatttgttccttaagattttttgacctgtgcttaa

SEQ ID NO: 916 - DNA, 3634 bp, Homo sapiens
agcgggtattcacgcgccggaagtgcatttgcagagtgagacaaagcggagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccagtaagtattcttgaaacaataacccttccataagtttgaagaattaaaggcaggccgggcatggtggctcacgcctgtaatcccagcactttgggaggcgccaagctgggtggatcatctgagggcaggagttcgagaccagcctggccaacatggtgaaaccttgtctctactaaaaatgcaaaaattagctgggcgtggtggcacacgcctgtaatcccagctgcttgggaggctgagacaggagaatcacttgaacctgggaggcagaggttgcagtgagccgagatcgtgccactgcactccagcctgggtgacagaacgagactccatctcaaaaaaaaggaagaattaaaggtaaattcttagggacagtttttggctaacaggtatataggggagtggggtaatggtggtggcatggaggggagtgtagtgcttaccatggttttctgtttgcctttaatggtcctatttgctgtcttactatgggtctgtctatatgaatttaatatacagttggcttgattcgtattgggggaaagagttcttttggtttgacaacttctgttaccgcaacagctttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaagttgcacaagttccttattttccttaatatttcacttctatttaatacaagctgggacataaaaattctgttggggatacctgggggaagatgtgagaaactaatgctgaattcagcttatacatgatgaaaagaaaaaccagacaaaaggagcacataaatatgcatacagtgtaactgttattattttaatacccacgataagggatttttgttagcatgtttagggggaacgaggattggtgggatccttgggccacaggaatctgaggcaacggaagatatatagagtgatcgtccccctgccgaaggaacctggcatctgtcaagcagatgctgcagttcaaacttcagcttttaagatagatagctattgaaggcagagggtcagcaggaggatgtgtatttctaatctaccctggtaaagtcataggtaagactcaaaagcgggatcttattcaaaaggcaggtatttcctttgttttctgtcttgaaatagccccttcccctaaggtgcattctctcaagttttcagtattgctttatttgcagtgattaaaagagatgagagactttggagacagacaacgtaagcaacacatacacacatgaaatactctagacagagatgaatataaatctggcctaataaccagttttccatgtaacagtgattttgtgtttcgggctgaagcagtggttatattaaaagccactaattcccttatccctttaaaagatttttacaattctccaaccacaaacagcacttctaaaactaactttactttctgcccataatttgttctacatggaaaaaaaaaatattactttggccaggggtgtgtgtaaatgtggcagaattcctaggcaggctgacctttacagtatgggcctttaagatactggatcctggttgggcacagtggctcacgcctgtaatccagcaccgaggccaagaaaattactcaatttcttaagctatattgaagggttttctctgtccttacaggtcaaatgaataatttgtgacacctaggtcagcttgctccatgtcctatttagtaatcaaagaagagtggcactatttatgactaataaattgaaattcaaaaacagccatgaatacaggcaagaaaagtttctctaaataactattctgtaaaagaaatgaagatttcacatacttgaaattactgctcagccagccacataagtagtttccctatgcttgtaagccagatgtttgatcagtatattagtaaataaaaagctgagcttacacaagtatttccttggcacactgaactttctttttgaaacatatcactctgttacccaggctggagtgcagaggtgcaatcctggctcactgcaacctccgcctcctgggttcaaatgatcctcctgccttagccttccgtgttgctgggatcacaggcatgcaccaccatgcccggctaatttttgtatttttagtatagacaggttttcaccatgttggccaggatggtctcgaactcctgacctcaagtgattcacctgccttggcctcccaaagtgctgggattacaggtgtgagccacggcacccggcctgaagtttctgaaaacaaattagaagactgttggcttggctaatctcgtagttcagggccaagtttctgtagtcagaatgaagaataaaattgaaagaaaaagggggaaatgcttatacttggcattaagttgaatgcctcaagtcttaactatggctttgtagatgaggcaaaagatttcttagtggtaaaatttcttcaacaggtcaatgccaatctgtatgccattttagtaaagtaggtaaggagagtagccgctcagtaactttggcactaaagaaagagtgtggctctagaacttccaattccattgctagatgtgccctttaaaagatggtccagtgctttcagggaaggatgtttagccagttttcctagtatttgttccttaagattttttgacctgtgcttaa

SEQ ID NO: 917 - DNA, 2925 bp, Homo sapiens
agcgggtattcacgcgccggaagtgcatttgcagagtgagacaaagcggagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaagttgcacaagttccttattttccttaatatttcacttctatttaatacaagctgggacataaaaattctgttggggatacctgggggaagatgtgagaaactaatgctgaattcagcttatacatgatgaaaagaaaaaccagacaaaaggagcacataaatatgcatacagtgtaactgttattattttaatacccacgataagggatttttgttagcatgtttagggggaacgaggattggtgggatccttgggccacaggaatctgaggcaacggaagatatatagagtgatcgtccccctgccgaaggaacctggcatctgtcaagcagatgctgcagttcaaacttcagcttttaagatagatagctattgaaggcagagggtcagcaggaggatgtgtatttctaatctaccctggtaaagtcataggtaagactcaaaagcgggatcttattcaaaaggcaggtatttcctttgttttctgtcttgaaatagccccttcccctaaggtgcattctctcaagttttcagtattgctttatttgcagtgattaaaagagatgagagactttggagacagacaacgtaagcaacacatacacacatgaaatactctagacagagatgaatataaatctggcctaataaccagttttccatgtaacagtgattttgtgtttcgggctgaagcagtggttatattaaaagccactaattcccttatccctttaaaagatttttacaattctccaaccacaaacagcacttctaaaactaactttactttctgcccataatttgttctacatggaaaaaaaaaatattactttggccaggggtgtgtgtaaatgtggcagaattcctaggcaggctgacctttacagtatgggcctttaagatactggatcctggttgggcacagtggctcacgcctgtaatccagcaccgaggccaagaaaattactcaatttcttaagctatattgaagggttttctctgtccttacaggtcaaatgaataatttgtgacacctaggtcagcttgctccatgtcctatttagtaatcaaagaagagtggcactatttatgactaataaattgaaattcaaaaacagccatgaatacaggcaagaaaagtttctctaaataactattctgtaaaagaaatgaagatttcacatacttgaaattactgctcagccagccacataagtagtttccctatgcttgtaagccagatgtttgatcagtatattagtaaataaaaagctgagcttacacaagtatttccttggcacactgaactttctttttgaaacatatcactctgttacccaggctggagtgcagaggtgcaatcctggctcactgcaacctccgcctcctgggttcaaatgatcctcctgccttagccttccgtgttgctgggatcacaggcatgcaccaccatgcccggctaatttttgtatttttagtatagacaggttttcaccatgttggccaggatggtctcgaactcctgacctcaagtgattcacctgccttggcctcccaaagtgctgggattacaggtgtgagccacggcacccggcctgaagtttctgaaaacaaattagaagactgttggcttggctaatctcgtagttcagggccaagtttctgtagtcagaatgaagaataaaattgaaagaaaaagggggaaatgcttatacttggcattaagttgaatgcctcaagtcttaactatggctttgtagatgaggcaaaagatttcttagtggtaaaatttcttcaacaggtcaatgccaatctgtatgccattttagtaaagtaggtaaggagagtagccgctcagtaactttggcactaaagaaagagtgtggctctagaacttccaattccattgctagatgtgccctttaaaagatggtccagtgctttcagggaaggatgtttagccagttttcctagtatttgttccttaagattttttgacctgtgcttaa

SEQ ID NO: 918 - DNA, 2864 bp, Homo sapiens
agctcggtaccctttcccaacgagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccaagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaagttgcacaagttccttattttccttaatatttcacttctatttaatacaagctgggacataaaaattctgttggggatacctgggggaagatgtgagaaactaatgctgaattcagcttatacatgatgaaaagaaaaaccagacaaaaggagcacataaatatgcatacagtgtaactgttattattttaatacccacgataagggatttttgttagcatgtttagggggaacgaggattggtgggatccttgggccacaggaatctgaggcaacggaagatatatagagtgatcgtccccctgccgaaggaacctggcatctgtcaagcagatgctgcagttcaaacttcagcttttaagatagatagctattgaaggcagagggtcagcaggaggatgtgtatttctaatctaccctggtaaagtcataggtaagactcaaaagcgggatcttattcaaaaggcaggtatttcctttgttttctgtcttgaaatagccccttcccctaaggtgcattctctcaagttttcagtattgctttatttgcagtgattaaaagagatgagagactttggagacagacaacgtaagcaacacatacacacatgaaatactctagacagagatgaatataaatctggcctaataaccagttttccatgtaacagtgattttgtgtttcgggctgaagcagtggttatattaaaagccactaattcccttatccctttaaaagatttttacaattctccaaccacaaacagcacttctaaaactaactttactttctgcccataatttgttctacatggaaaaaaaaaatattactttggccaggggtgtgtgtaaatgtggcagaattcctaggcaggctgacctttacagtatgggcctttaagatactggatcctggttgggcacagtggctcacgcctgtaatccagcaccgaggccaagaaaattactcaatttcttaagctatattgaagggttttctctgtccttacaggtcaaatgaataatttgtgacacctaggtcagcttgctccatgtcctatttagtaatcaaagaagagtggcactatttatgactaataaattgaaattcaaaaacagccatgaatacaggcaagaaaagtttctctaaataactattctgtaaaagaaatgaagatttcacatacttgaaattactgctcagccagccacataagtagtttccctatgcttgtaagccagatgtttgatcagtatattagtaaataaaaagctgagcttacacaagtatttccttggcacactgaactttctttttgaaacatatcactctgttacccaggctggagtgcagaggtgcaatcctggctcactgcaacctccgcctcctgggttcaaatgatcctcctgccttagccttccgtgttgctgggatcacaggcatgcaccaccatgcccggctaatttttgtatttttagtatagacaggttttcaccatgttggccaggatggtctcgaactcctgacctcaagtgattcacctgccttggcctcccaaagtgctgggattacaggtgtgagccacggcacccggcctgaagtttctgaaaacaaattagaagactgttggcttggctaatctcgtagttcagggccaagtttctgtagtcagaatgaagaataaaattgaaagaaaaagggggaaatgcttatacttggcattaagttgaatgcctcaagtcttaactatggctttgtagatgaggcaaaagatttcttagtggtaaaatttcttcaacaggtcaatgccaatctgtatgccattttagtaaagtaggtaaggagagtagccgctcagtaactttggcactaaagaaagagtgtggctctagaacttccaattccattgctagatgtgccctttaaaagatggtccagtgctttcagggaaggatgtttagccagttttcctagtatttgttccttaagattttttgacctgtgcttaa

SEQ ID NO: 919 - DNA, 841 bp, Homo sapiens
agcgggtattcacgcgccggaagtgcatttgcagagtgagacaaagcggagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagacgcctccggaggcgttgaatggccggggagcgtgacaagttccggaagatgctggacgccaaggagcaggagatgacggagatgcgggacgtgatgcagcagcagctggccgagtaccaggagctgctggacgtgaagctggccctggacatggagatcaacgcctccgggccattcaacgcctccgggccattcaacgcct

SEQ ID NO: 920 - DNA, 1405 bp, Homo sapiens
agcgggtattcacgcgccggaagtgcatttgcagagtgagacaaagcggagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccagtaagtattcttgaaacaataacccttccataagtttgaagaattaaaggcaggccgggcatggtggctcacgcctgtaatcccagcactttgggaggcgccaagctgggtggatcatctgagggcaggagttcgagaccagcctggccaacatggtgaaaccttgtctctactaaaaatgcaaaaattagctgggcgtggtggcacacgcctgtaatcccagctgcttgggaggctgagacaggagaatcacttgaacctgggaggcagaggttgcagtgagccgagatcgtgccactgcactccagcctgggtgacagaacgagactccatctcaaaaaaaaggaagaattaaaggtaaattcttagggacagtttttggctaacaggtatataggggagtggggtaatggtggtggcatggaggggagtgtagtgcttaccatggttttctgtttgcctttaatggtcctatttgctgtcttactatgggtctgtctatatgaatttaatatacagttggcttgattcgtattgggggaaagagttcttttggtttgacaacttctgttaccgcaacagctttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagaggtaaggcaaaagaaaagctgaattttgggtagttgtagtatacagtgaatagctgacctacttgatggtaggaaattggagttggtatttgagtttctttttttttttttttttttttttgagacggagtattgctctgtcgcccaggctggagtgcagtggcatgatctcggcaacctccgc

SEQ ID NO: 921 - DNA, 770 bp, Homo sapiens
agcgggtattcacgcgccggaagtgcatttgcagagtgagacaaagcggagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaaggtacagaggtatagatgttaccgtagcccatgggccagtcctgagttacacactcatcctcttctcctaggtggagttaacgtagatagctcttatcctgaagatttggaaactaaactgcttgaggctggtatttcggtattttatatatcagctacaaaagtgcttaataatttgaaaaatagaagatgtttggaacataaggtataagaaagtaggttgaaaactatcttttggtggcaacatcttccagttgaagtgatcctttttctactctggttcccttacaccacatatccaactgtcaggatactctgttggctttacctactactttttcctgtgttcacctctcatcctaatccaagccaccatccttcatctagatttctgcagtagcccggctaatttttgtatttttagtacagacagggtattgaagctcat

SEQ ID NO: 922 - DNA, 381 bp, Homo sapiens
gagatggagtctccctctgtcgcccaggctggagtgcagtggtgcaatctcggttcactgcaagttccacctcccgggttcacgccattctcccgcctcagcctcccaagtagctgggactacaggcgcccgccaccatgcccgactaatttttttgtatttttgtagagacagggtttcaccgtgttagccaggatggtctcaaatctcctgacctcgtgatccgcctgcctcggcctcccaaagtgctgggattacaggcgtgagtcactgcacccggcccaaaattactcaatttcttaagctatattgaagggttttctctgtccttacaggtcaaatgaataatttgtgacacctaggtcagcttgctccatgtcc

SEQ ID NO: 923 - DNA, 3024 bp, Homo sapiens
agcgggtattcacgcgccggaagtgcatttgcagagtgagacaaagcggagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaagttgcacaagttccttattttccttaatatttcacttctatttaatacaagctgggacataaaaattctgttggggatacctgggggaagatgtgagaaactaatgctgaattcagcttatacatgatgaaaagaaaaaccagacaaaaggagcacataaatatgcatacagtgtaactgttattattttaatacccacgataagggatttttgttagcatgtttagggggaacgaggattggtgggatccttgggccacaggaatctgaggcaacggaagatatatagagtgatcgtccccctgccgaaggaacctggcatctgtcaagcagatgctgcagttcaaacttcagcttttaagatagatagctattgaaggcagagggtcagcaggaggatgtgtatttctaatctaccctggtaaagtcataggtaagactcaaaagcgggatcttattcaaaaggcaggtatttcctttgttttctgtcttgaaatagccccttcccctaaggtgcattctctcaagttttcagtattgctttatttgcagtgattaaaagagatgagagactttggagacagacaacgtaagcaacacatacacacatgaaatactctagacagagatgaatataaatctggcctaataaccagttttccatgtaacagtgattttgtgtttcgggctgaagcagtggttatattaaaagccactaattcccttatccctttaaaagatttttacaattctccaaccacaaacagcacttctaaaactaactttactttctgcccataatttgttctacatggaaaaaaaaaatattactttggccaggggtgtgtgtaaatgtggcagaattcctaggcaggctgacctttacagtatgggcctttaagatactggatcctggttgggcacagtggctcacgcctgtaatccagcaccgaggccaagaaaattactcaatttcttaagctatattgaagggttttctctgtccttacaggtcaaatgaataatttgtgacacctaggtcagcttgctccatgtcctatttagtaatcaaagaagagtggcactatttatgactaataaattgaaattcaaaaacagccatgaatacaggcaagaaaagtttctctaaataactattctgtaaaagaaatgaagatttcacatacttgaaattactgctcagccagccacataagtagtttccctatgcttgtaagccagatgtttgatcagtatattagtaaataaaaagctgagcttacacaagtatttccttggcacactgaactttctttttgaaacatatcactctgttacccaggctggagtgcagaggtgcaatcctggctcactgcaacctccgcctcctgggttcaaatgatcctcctgccttagccttccgtgttgctgggatcacaggcatgcaccaccatgcccggctaatttttgtatttttagtatagacaggttttcaccatgttggccaggatggtctcgaactcctgacctcaagtgattcacctgccttggcctcccaaagtgctgggattacaggtgtgagccacggcacccggcctgaagtttctgaaaacaaattagaagactgttggcttggctaatctcgtagttcagggccaagtttctgtagtcagaatgaagaataaaattgaaagaaaaagggggaaatgcttatacttggcattaagttgaatgcctcaagtcttaactatggctttgtagatgaggcaaaagatttcttagtggtaaaatttcttcaacaggtcaatgccaatctgtatgccattttagtaaagtaggtaaggagagtagccgctcagtaactttggcactaaagaaagagtgtggctctagaacttccaattccattgctagatgtgccctttaaaagatggtccagtgctttcagggaaggatgtttagccagttttcctagtatttgttccttaagattttttgacctgtgcttaa

SEQ ID NO: 924 - DNA, 839 bp, Homo sapiens
agcgggtattcacgcgccggaagtgcatttgcagagtgagacaaagcggagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcatctgatatatggaggcacatcctaaagcactagaaattatttttttgtacattatcataatgggagagacaagagtccaacagtataacaaagacattcccacgcgtttgcgcctgggttagctc

SEQ ID NO: 925 - DNA, 2891 bp, Homo sapiens
agcgggtattcacgcgccggaagtgcatttgcagagtgagacaaagcggagaacgctggtgggcctgttgtggagtacgctttggactgagaagcatcgaggctataggacgcagctgttgccatgacggcccagggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccaagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaagttgcacaagttccttattttccttaatatttcacttctatttaatacaagctgggacataaaaattctgttggggatacctgggggaagatgtgagaaactaatgctgaattcagcttatacatgatgaaaagaaaaaccagacaaaaggagcacataaatatgcatacagtgtaactgttattattttaatacccacgataagggatttttgttagcatgtttagggggaacgaggattggtgggatccttgggccacaggaatctgaggcaacggaagatatatagagtgatcgtccccctgccgaaggaacctggcatctgtcaagcagatgctgcagttcaaacttcagcttttaagatagatagctattgaaggcagagggtcagcaggaggatgtgtatttctaatctaccctggtaaagtcataggtaagactcaaaagcgggatcttattcaaaaggcaggtatttcctttgttttctgtcttgaaatagccccttcccctaaggtgcattctctcaagttttcagtattgctttatttgcagtgattaaaagagatgagagactttggagacagacaacgtaagcaacacatacacacatgaaatactctagacagagatgaatataaatctggcctaataaccagttttccatgtaacagtgattttgtgtttcgggctgaagcagtggttatattaaaagccactaattcccttatccctttaaaagatttttacaattctccaaccacaaacagcacttctaaaactaactttactttctgcccataatttgttctacatggaaaaaaaaaatattactttggccaggggtgtgtgtaaatgtggcagaattcctaggcaggctgacctttacagtatgggcctttaagatactggatcctggttgggcacagtggctcacgcctgtaatccagcaccgaggccaagaaaattactcaatttcttaagctatattgaagggttttctctgtccttacaggtcaaatgaataatttgtgacacctaggtcagcttgctccatgtcctatttagtaatcaaagaagagtggcactatttatgactaataaattgaaattcaaaaacagccatgaatacaggcaagaaaagtttctctaaataactattctgtaaaagaaatgaagatttcacatacttgaaattactgctcagccagccacataagtagtttccctatgcttgtaagccagatgtttgatcagtatattagtaaataaaaagctgagcttacacaagtatttccttggcacactgaactttctttttgaaacatatcactctgttacccaggctggagtgcagaggtgcaatcctggctcactgcaacctccgcctcctgggttcaaatgatcctcctgccttagccttccgtgttgctgggatcacaggcatgcaccaccatgcccggctaatttttgtatttttagtatagacaggttttcaccatgttggccaggatggtctcgaactcctgacctcaagtgattcacctgccttggcctcccaaagtgctgggattacaggtgtgagccacggcacccggcctgaagtttctgaaaacaaattagaagactgttggcttggctaatctcgtagttcagggccaagtttctgtagtcagaatgaagaataaaattgaaagaaaaagggggaaatgcttatacttggcattaagttgaatgcctcaagtcttaactatggctttgtagatgaggcaaaagatttcttagtggtaaaatttcttcaacaggtcaatgccaatctgtatgccattttagtaaagtaggtaaggagagtagccgctcagtaactttggcactaaagaaagagtgtggctctagaacttccaattccattgctagatgtgccctttaaaagatggtccagtgctttcagggaaggatgtttagccagttttcctagtatttgttccttaagattttttgacctgtgcttaa

SEQ ID NO: 926 - DNA, 510 bp, Homo sapiens
caaagcagtgaggctgcaaccagctcatgatgtaatgaaaaatacatgaaatattgtggggttcataattgtgcttcttcaaacattccctgcctaatagcagtcaagtgagataggtagcttgtcctctgctcaattccctaataaatctttcccttcttgcccctgatcttgcaatgtggtcaggccccacagctctgtgttggaccatattatcttctctccccctcccttttccctttcccttcccattttcccctccctttatccttcctcctcctccatgcataaccttaaccattctcttggcctcacgtaaccacctcccaattctgtgccaccttcactctagaactataatgtgagccatacacctgaaactctactcagatccccccacaggcccctcacagtcaccctctccagaacctaactttcccttcttcccacttcaaatctgctgcttcttcagtttgacgggagtgttataggccttcccttgtaaaaggg

SEQ ID NO: 927 - DNA, 381 bp, Homo sapiens
aaagcatcagcagggccatgctctctctgaaggctttagagaagtatccttccttgctgcttcctagtttctggtggttgccagcaatccttggcattcctggacttgcagatgcatcactgcaatctctgccttagtatccacatgaaatttttcctgtgtgtctgtctgtgtccagattgtcttctttttatgggggccattcattggattagggtcttccctaatgcagtatggcctcatcttaatgtgattacatctacaaaaatactgtttcaggccgggcctggtggctgaagcctgtaatcccagcgctttgggaggctgagacgggcggatcacgagatcaagagatcgagaccatcctggtcaacatggtga

SEQ ID NO: 928 - DNA, 379 bp, Homo sapiens
caaaaaagtaaataaagatgtgatatcagtttatacctccacctttgttatatgagtgaaatgctgtttgtaacttgtagaaatagtagagatgggcgcctgagagatgagccaacatagtaaatgtctttatggatcagaactgtcatcacttgactttcttcatgagacagtgctaataaactggtattgggataaatgtagtttgacattggaaatactttccggtgttttccaatttgtgtgcattgaaaatttattaattttgaaattagaagggcaattagataatgttaggaaaaaacacaactaccatgtttttgtacacatgtaagtaacatacatatttgactatgtgtattaaccatgtttcaaaata

SEQ ID NO: 929 - DNA, 207 bp, Homo sapiens
gaaccacaggcatgtaccatgatacatggctaattttttaatctttttgtagagatgggggtctcactttgttgccaaggctggtctcaaattcctgacctcaagtgattcttcggccttggcctcccaaaatactgagattacaggcatcagccatcatgcccagcctatattttcttcatattaaataaaatcatgttctcatcc

SEQ ID NO: 930 - DNA, 152 bp, Homo sapiens
gttctcttgtcctggctctgtgtgaccttgggccagtcacttcccctctctgggactcaggagcaaaagacagaagcaagacatacatgccttctgcaagctctggactatgcttctccctacagcacattggaagcatggaggtctccgcc

SEQ ID NO: 931 - DNA, 197 bp, Homo sapiens
cttttttttttcgagacaaaatctcactctgtcgctgggctggagtgcaatggtgtgagactacatctaagaaaaaaaaaatacatacacacacacatacacacacacacctggaaactcaaagagtacgttcatactaaaagtttaacacaaacattcaactctgagacatggtctggttaagcagaagaactatg

SEQ ID NO: 932 - DNA, 526 bp, Homo sapiens
gacaaaaataacatctttactgaactaatcaataagttagaaacagctagaacagtttactgaaatcaaaattaccaacaaataggaaaggcataagataatcagaaaaattcaggccgcgcactgtggctcacacctgtaatcccagcactttgggaggctgagctaagcagatcacctgaggttaggggttcgagaccaccctggccaacatggaaaccccgtctctactaaaaatacaaaaacaaattggcccagtgtggtggcaggcacctgtaatcccagctacctgggaggttgaagcaggcgaatcacttgaacctgggaggtggaggttgcagtgaggtgagatcacaccactgcactccaacctgggcaacagattgagactacatctaagaaaaaaaaaatacatacacacacacatacacacacacacctggaaactcaaagagtacgttcatactaaaagtttaacacaaacattcaactctgagacatggtctggttaagcagaagaactatg

SEQ ID NO: 933 - DNA, 832 bp, Homo sapiens
taggctaggtacgaggctgggtggtggtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacg

SEQ ID NO: 934 - DNA, 843 bp, Homo sapiens
ggacgcgtgggtcgacccacgctgtcggcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactgctcggtccagtgacccagatcccagggacctcagtcggcttaatcagagtgtggcatagaagctatttaatgattaaagtcatttgcagtacg

SEQ ID NO: 935 - DNA, 3079 bp, Homo sapiens
  misc_feature (17)..(17): n is a, c, g, or t
gcgagttgtgtgagcgnagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggcgaggctaccagggggacccgtcgtcggcactgctggagctgctggaccagagcagaatgccaacttcctggaccactacctggacgtgcccgtggacttgtccaaggtgctgttcatctgcacggcaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacg

SEQ ID NO: 936 - DNA, 2957 bp, Homo sapiens
  misc_feature (17)..(17): n is a, c, g, or t
gcgagttgtgtgagcgnagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggcgaggctaccagggggacccgtcgtcggcactgctggagctgctggacccaggagaagctggcattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacg

SEQ ID NO: 937 - DNA, 2048 bp, Homo sapiens
  misc_feature (17)..(17): n is a, c, g, or t
gcgagttgtgtgagcgnagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtgcgtgcggagaggcccggagagccctaacccggcaatgccgtgtgcaaagatgaagcgagccttccgggtcctagggatccccgaagccaactcaggggggcaatcgccgtgatagctggccctgattggcacggacgggtcccttacaaccaagaggcaacgcacaggaggcttgccagtccaaggagggtgtgggtgcagtcacaatcggggtatcccaaggctgacctgaggtatacca

SEQ ID NO: 938 - DNA, 2217 bp, Homo sapiens
  misc_feature (17)..(17): n is a, c, g, or t
gcgagttgtgtgagcgnagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacg

SEQ ID NO: 939 - DNA, 2410 bp, Homo sapiens
  misc_feature (17)..(17): n is a, c, g, or t
gcgagttgtgtgagcgnagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagtgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggcgaggctaccagggggacccgtcgtcggcactgctggagctgctggaccagagcagaatgccaacttcctggaccactacctggacgtgcccgtggacttgtccaaggtgctgttcatctgcacggcaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacg

SEQ ID NO: 940 - DNA, 3108 bp, Homo sapiens
  misc_feature (17)..(17): n is a, c, g, or t
gcgagttgtgtgagcgnagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggcgaggctaccagggggacccgtcgtcggcactgctggagctgctggaccagagcagaatgccaacttcctggaccactacctggacgtgcccgtggacttgtccaaggtgctgttcatctgcacggcaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacg

SEQ ID NO: 941 - DNA, 2846 bp, Homo sapiens
  misc_feature (17)..(17): n is a, c, g, or t
gcgagttgtgtgagcgnagtatggccgggctatggcggcgagcactggctacgtgcgactgtgggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggcgaggctaccagggggacccgtcgtcggcactgctggagctgctggaccagagcagaatgccaacttcctggaccactacctggacgtgcccgtggacttgtccaaggtgctgttcatctgcacggcaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacg

SEQ ID NO: 942 - DNA, 2351 bp, Homo sapiens
tcgtgccgattcggcacgagcaagtacagcaacgagaacctggacctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggcgaggctaccagggggacccgtcgtcggcactgctggagctgctggaccagagcagaatgccaacttcctggaccactacctggacgtgcccgtggacttgtccaaggtgctgttcatctgcacggcaacgtcacggacaccatccccgagccgctgcgagaccgtatggagatgatcaacgtgtcgggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacg

SEQ ID NO: 943 - DNA, 1515 bp, Homo sapiens
  misc_feature (17)..(17): n is a, c, g, or t
gcgagttgtgtgagcgnagtatggccgggctatggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactgctcggtccagtgacccagatcccagggacctcagtcggcttaatcagagtgtggcatagaagctatttaatgattaaagtcatttgcagtacg

SEQ ID NO: 944 - DNA, 552 bp, Homo sapiens
  misc_feature (17)..(17): n is a, c, g, or t
gcgagttgtgtgagcgnagtatggccgggctatggcggcgagcactggctacgtgcgactgtgggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggactgcaggcggcggatgtcaggccctgtctgggccagaactggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtacg

SEQ ID NO: 945 - DNA, 473 bp, Homo sapiens
aaccacctgaatccagtgtcccaagcatatcctcatccccatgataacctcaaccaaaacctgacccaaaccaatttaacacagcccaatccaaccacatcacccacaagcccaacccatcaacccaacacaacttaatctaattcaagacaaccctaatagcctccttcatttaaagatcaaaccaaactaatgcacatcctcgcatgcaatagccagctccatgtattctatctccaaaactaaacctacttcatccccaattcaatccccacacccttcccagccaacataaaaacaaacctatttccatcccaaagccatgccatcccaaaccacctttaaattgccaatccccaaactcatccgaagcagaattttaccccatctgtaactcaactccaacctgaccctccattctaactggtcttcatactccgttttcaatgctatatccagcactttatctggcc

SEQ ID NO: 946 - DNA, 487 bp, Homo sapiens
cccacctgttgagatctctggtctagacacatcttttaaaatgtgggcagagaagaaggaggtagatgaaaatcacgtgacaccatcagaggtaatggtgaatccgtgaggccctagagccatttatacatcgtttttgccctcttagtattttctttagcatgtcctaattttaaaagcatcccattcctgttgtgctagacttaatattttggtttatggccgtcttttttagtaacttgacgtcaaacacttcagccttctcctgacaagaggctcgttctctcagtaatgaatagtgacgtgctaaatttagatcggatgcatgttctgcttttactatctgttctgtatgttgctatttgtcagaatgaaagctcaacgtgccagatggctttgctggcttctcctggaaaaagacttcgttctccatcacttcagttgggtcatggttttttagtactattttgttgttaagcattaatat

SEQ ID NO: 947 - DNA, 278 bp, Homo sapiens
tagagacaaggtgtcactatattgcccaggctagtcttgaattcctgggcccaagagattctcccaccttggcctcccaaagtaaaaactcacattttcttaaaggtgggtaagcaaaagatcagggtgaaggaaaccctctccttttcagacaccaccctacgatgcctgtttgcccttcttcaccaagaagccagctgtccgtggctgggccagcgtgacagactcaggggacattggatacagctctcttttcaatggctcctagagttaagact

SEQ ID NO: 948 - DNA, 513 bp, Homo sapiens
cgctcaggtgtctgttattcggggtcgatgagcaggattggaggctgggggcaggagtgctagctccgatattagcataatataaaaactacacagcactacgttgttctgcataaaacagttgctttcatgacatttattttatatgtcaggtaacaattaatttttagactaacaaataaatataaatagggaataaggaaaagattatgagacaacgtccatagctcatacttcatgtgtcagataatggtaagtgtttagacttacaaatctaaataaggattaagggaaattattacagaaaaatttccatagtggttcactccttggatcctgaagcaagttactaaggaagagactgattcaaaggacacatattaatctatgggttttttggccaggtgtgggtggctcacacctgtaatcccagcactttgggaggcctctggcagatcacttgaggtcaggagtttgaggccagcctggtgaaaccctgtctttactaaaata

SEQ ID NO: 949 - DNA, 429 bp, Homo sapiens
aatcttaatctaaaacagattggtggccatgcctgtggaaaagttagagagaatttgtccagtactgggttttttcagagctatgtagagagagcagtgaccagatattttaaaagacattacccttcaatttagtggcacaggtactggccaagaaaatctaatatggttccttccaacaaatttggagtaaatcttcttcataaaagtagaaaatcaaattttatttttatattattaatattaaagctaaccttaggaaagcattataaacagatgtattcaatctcaatcagctttgaccatacaagatttctgtaaaccttttataaccccttaaaattttatttttctctttctccagctttctatatccattaagtttacctcattttctttatcttttttctctcaattttatgtattttt

SEQ ID NO: 950 - DNA, 387 bp, Homo sapiens
aaataatggaaacaaacacaagatttgcttggccaaaataaacaatatgcaaaatacacacacacacacacacacacccacacacacacacaccccaccagaaaaaaatcaaacttttacactaagtccagacatttttaagagtttacaaaggctatctaagcattatgcaaaaataatgctaggaagaccatttgtaggagtcaaagtaaatgtacccgggaatgaatcctttatgtcttgtttgccttaggaaaaggaattgaaattagtgacattatataaaaaaactgaaaacataagttttgagaagatgagtacttgtacacttgaatactgttcgtgttttaaataaaaaattgttttaatataccatatctagaggaa

SEQ ID NO: 951 - DNA, 780 bp, Homo sapiens
gcttggatttgaacttcagtttgcctggctcaaatgaggctgcagagttgggaaggacttaaaaagtttggagatttttgccataaatattgatttttctgcaaatgaggatgaacatcttaatggcctttaagaaactttgcaaatagttttcaaaaatgatgcaacatggcagagaaaatgcacttggcttccagctccctcaacagccattaacagcctcctaccgtggctcccacctcctatgtctccagagatcaaggcaatggggagggaaagctggcaggaggcagtcccttgtgggcctgaggccctttggctcctaagtgtccacattctgttctcttccaagtcccttcattgttaagctgattctccaacaagatgcaatgaacagatgcaatgtctaccccgcgctgggcgagttcccgaggccatgggctgtttggaatcacacttcattaagagacaaactgttccttcccttattgtgccttaatgcttatgacaaggcagctctgaattgatcccaagctggagcctctgaatgctttaaagagtttgaatatagacggtttgagagcaaaaagggagctttaaatattgctcagtggcccccatctcccctcttcccacatttactgaggcacgagatggggatgggacctgtcctggggtcacagcagcagtcgtcagcgacttgggccctcctggctttgtagggatgctgcttttcctgggcttctggcagtccaggccaggatgggggagccaggaatt

SEQ ID NO: 952 - DNA, 388 bp, Homo sapiens
attcatccagattctgaagagggcgctggggcaggtgttttcttacgtgaggcccagcacaattacagacgctctttgatttacaaaggagtcacatttggataaatctatcataaaacaaaaatatcctactttgaaagtgcattcagtacgctggacctaccaaacataacttagccttgcctgccttagcctagcattctgtctagctcagaatgcttatattagcctacagcaaaatcatctaacaccaagcctgttttataataaagtgattataaatcattttgaatcaaaattaaaaattcaaagtatggcttttactaagtaaatatcacatttgcaccatcctaaagtcaaaaaattataagtcaaaccatcgtaagtc

SEQ ID NO: 953 - DNA, 412 bp, Homo sapiens
gcacgtagcatagagtgcttcatttaattcttctggtaaacgtgtcaataatactgtcctcaacttacagatgaggtagcagagactcagagaatgaagtcacttgtccaacaagtttacgcagctggaaagtagcgggtggtaagtggctggtttccttttcttcacctcatcgttcttagaaggctaacggtagggtgataaggaaggagagaagggaaaatagcagaggaagtgaggggaaggagggagggaggagaagtgcgctcagattaattagaaacagtgagagagggccaggtgcagtggctaatgcctgtaatcccggcactttgggaggccgaggagagtgaatcacataaagccaggagttcgagaccagcctggcccatgtggtgaaaccccatcccta

SEQ ID NO: 954 - DNA, 430 bp, Homo sapiens
tttttttctggaggattacattgattgatatctaatatcgagacagccttgcaatcctggtttacaaaataaacctcactttgttattacatgttattcattttacatcttcatttgatttgctagtattttattgagaatgcttgcattatggtcatgagaaatatttctttgtatttctctctctcgtctgttttgttgtctggttttggtacaagggttactctttggaggccaggattactcttctggcctcgtaaaatgaactgggaagtgttcattcttcacctattttctgaaggaaattttttggaattggcattatttcttccataatagtttggtaaaatacaccaatgaaactacctgggcctggagatttctttggcaaaaggatttttaacaataattcaatttctttaacaggtat

SEQ ID NO: 955 - DNA, 317 bp, Homo sapiens
tgggtgtatatcttcagcttgctttgtgtcattcttgtggtcctcttgggggagagaccataagtcactgttgatggatgacaaagggtttgacccttcccaaaggtccaaagactgtccctgctgaagcctgtcccaccactgctggttactctcactgcctcactgcctcctgttttccttccttttatgattctctatttattaatgttcctctttattatcctcttccccagctagactgtaatgtgtgcatggacagggaccatagcagttttgtcactctctgtccccggggcctagcccacaacacatag

SEQ ID NO: 956 - DNA, 381 bp, Homo sapiens
ctagctgtcatactggtaataataatttcccatagttggaaggacagttctaaaactatctgtgaaagttttacaagtccaaaagccaattttgtatgaaaagaaaaattagtgatttaaaatacacaactcaaacaatacctttgctcatacctgcaactgagtttttcttttttggggggtataatgtaaacagaaacatataggtacagatcttgttaatgctccttaacttcttttttgttttttgagatggagtttcactctgtcacccaggctgaagttgcagtgagccgagatcacgctactgctccccagcctgggtgacagagcaagactccgtcacaaacaaacaaacaaactagataaatctagattcaa

SEQ ID NO: 957 - DNA, 541 bp, Homo sapiens
gggtccttcaaaataatacagaggaaaattaaaaggatagggtgttgcactcatgggtacaaaaggctaaagcactttgacttcagagtaaacccctctttattttgtcaaatggtagccttgtctgcctgttggtctgttcccaggccacctatcttacagggaactctgcctgttgacaagtgtcatgcctttctatgaagcctaccctcttcttcaaaaggattgttagggaaacaggacaaccaaactgcagatgcaactcacacaggaggaaaaagaatagaatggaagagacagatcaagacgaacagacagaacaaccaacacctggatgaaaaagaaacaatttaggtaagagaagagaatttaaaaaaaattaaaattctacttagtgtcttcgggagtattaaggaagttggatccataaaacaaagatgactactaaacaaaaagaagcaattagaagatacaaaagagttcttggaaatttaaatattcagtatacatgctaaatattagaaagaacacagttgaaaaa

SEQ ID NO: 958 - DNA, 859 bp, Homo sapiens
cgtgcagcctgcagtgctgcctggcgtttgggggtctggggttgtcgcccctctttatgtctgatgttagacataggagtgagtgtgttgtcggccggtcaccttttcctgagccgcccccagcgctgcggaggagcagggcgcccctgagcctgacgcagcacccacctcgtggtgctgcttcccccaggaggagtctggatcctcagcactgtctgctcaccatcatggcaggcacaattcggaaacgctcttctggttcctcattctatagcagagtagtaatggccactaaaaacaccctggcagaggcaggatcaagaagcgacgtgcgtttaacaaataactcacagggaaagtaaaaggaggctgagagggaaccacagagtcaaggaaactcgagagacctatggccagctgccatgtacagtaaaccttacttggttctgttgaagttccaaaaatgaatactcataaaacaattagaaattttacaggtgctggatttatgttattcaagaatcattgttcgtttttcttgggtgtggtaactggatcatgtttttataaaagagacctaattttttagagatagacactgaatattcaccaatgaaatcacatgacatatgagccttaatttactgtgcttgggagcggtgcggtggggcggtgggtgcggaaccgctgtcactagctgggtggtgagtacctgggtttggtgtatttaagtattttcatcagataatgttgacaaagagtggtaattgatagtccagcactgaaggacgagagaaaacatccaaaacttggaagaatcattcagcactcaccactgggccattttcactccaggtgc

SEQ ID NO: 959 - DNA, 844 bp, Homo sapiens
atatcatttactgtgaaatactgattcatgaagaaatggatgagtatggtggcattaagacctgtagttttactcacataaggttgaaggggatgagactcctggtttatctagcattgtaaccatattacagaatttttgccttctccagtagtagaatagtagaattattaagaagacatagtagcttctaacacttaatgagtactggctatgtgagagagactaataagtactacgcatgccttctttcatttaaccctcaggttaaaaattttctctggctgggtgcggtggctcatgcctgtgatcccagcactttgagaggcagagtgtgacttgtctgcctttctctccagtattgtgatgtctctgtttttcaggaatggaggttcctctgctggctctatagccagagacccaaagtgacagccatgtttcttgattcaaccctggaaaccttctatgataatttttaaaaattactaaccatttattaagcacctacaatattttagtacctttgatacagtagatccagaccttatgataacggtgtaacacaaatacctatgtggatgaatggtttttaatctttttgagctcacccaaagattaaaaagccttctgtgagatactggtgacagctctggaccttctttccagaaaaattcacttatgcacatatacatagtattgtacacaacttcagaagaggcttctaggacctaccgaagcccatcctctagtagtccacagactccagggtaagaactcttgacttatacaaccctttgtagctgactcttgtatggcattaagggtatagagagtgtggggggca

SEQ ID NO: 960 - DNA, 842 bp, Homo sapiens
ctcccccatccccctcatccctcagcccctgacagccatcattctactttatgaatttgactactactggtacctcatacaagtagactcatgtaatatttgtgcttttgtgactggcttatttcacttagcataatgtcttcgaggtttatccatattgtagcatgtgtcagaatttccttcctttttaaagatgagtaatattcattgtatgcatataccacaatattttgtttatccatctgtccatggacacttgggttgctgccatcctttgactattgtgaataatgctgctatgaacatggatctgttcaagtcccagctctgaattcttttgggtatatgcccagaagtgggattgctggatcatatggtaattcttttattttttgaagaaccaccataccattttccatagcagctgtctcattttacattctttccagcaatgtacaaggattccagtttctctacatccttaacaacactggttattatcagtaaattttttttgacacccataggccaaaagaaatacctaatagttttgttaaatagttatacccaaacaacatgagtattttttataaccgcttagtaactgtttgaaaataaaaaggccaggcgcagtggcgtatgcctgtaatcccagctctggaaggattgcttgagtccataagttcaagaccagcctgggcaacatagtgagaccttgtttatacaaaaaaatttttaaatgaggtgggaggatcacttgggcctgtgaggtcgaggctgcaatgaagctgtaattgtaccactgcactcctgcctcagcaacaggagtgagaccctatata

SEQ ID NO: 961 - DNA, 770 bp, Homo sapiens
aattgactccatagacaaagatctaaatataataactaaaactataaaactcttagaagaaaatgtaggggaaagcttcattacactggattggtttcttggatatgacaccaaggcagcaaaagaaaaaataatttgaggaaagaaatctttcctcaaaacgttttggccagacatggtgactcacgcctgtaatcccagctgtttggaaggtcacagcaggaggatcccttgaggccaggagttgaagaccaacctggacaacatagtgagacctcatctctacaaaaaataaaaattaaaaaaattagctgggcatggtggcgtgcacctatagtcctagctactccagaagctgagatgagaggatgactggagcccaggtttgaggttacattgagctatgaaagcaccactgcactccagcctgggtgacagagcgagaacctgtctcttaaaaaaaaaagaaacaagaaaaaaacttcagtgcatcaaaggacatcaacagagtaaaaaagcaatccaaaaaatggaagaaaatatttgcaaatcatatatcttataaggatttgctatggtttggatgtttgtctccttcaaacctcatgtcaaaatttgatccccattgttagaggtagggcctaatgggatgcattcgggtcatgggggcagatccctcatgaatagattaacagcctcccttagagataagtgaattctcactgcattagttcccgtgagagcttgttgttaaaaaaacaaaaacaaaa

SEQ ID NO: 962 - DNA, 469 bp, Homo sapiens
ggaggctgaggtgggtggattgcttgaggtcaggagttagagaccagcctggctaacgcggtgaaacctcgtctctactaaaatacaaaaattagccggatggggtgcttggtgcctgcaatctcagctactcgggaggctgaggcaagagaattccttgaacctaggaggcagaggatgcagtgagccgggactgtgccactgcaccactccagcctgggtgacagagcaagattccgtctcaaaaagcaaacaaacacaattcctattatacatgagttttgtctctgagttattttttaaattggttactttttctgtcttagcacaacactaccatttttaattgtatggctctaagaatatcttaatacctgagagagcaagaccctctcctttttacagtgagaaataaagctagcccataattttggtgcatatacgtacagatttctctaatgaactgacg

SEQ ID NO: 963 - DNA, 413 bp, Homo sapiens
taaccataattactattagcaatctgaagaaacacatatctaatgatagaagttcaggcatagtgtggcaggcaggcccctgggagggatgaatttgcacaagcaaactgccttctccatggagacctaatgaaattcatccggtccttcttgagagtttgactgagttgggaactgtgtctccaccagaccagcaaatggaagagaagtttcctggggctctagctgaagagtgtgtactgaggggcagtattgcattgtggttgagaacatgggctctagagccaggctgctcaggttcaatgcccagctccatcacttacctgctgggcagcagcctgagttatttaaacctcactaggcacaatgtaaggataacaatattgactatcccataaggttgctggggatgc

SEQ ID NO: 964 - DNA, 376 bp, Homo sapiens
ggtaagatttgacatgggcatacctggttttatgcagtctagacataaaatcttataaacacatacctataaaacacatgttaaaaattggagcctgggccaggcgcggtggctcacgcctgtaatcccagcactttgggaggctgaggtgggcggatcacgaggtcaggagatcaagaccatcctggctaacacggtgaaaccccgtctctactaaaaatacaaaaaaattagcctggtgtggtgggcgcctgtggtcccagctactcgggaggctgagggaggagaatggcatgaacccaggaggcggagcttgcagtgagcagagatcatgccactgcactccagcctgggtgacagagcgagactccatctc

SEQ ID NO: 965 - DNA, 237 bp, Homo sapiens
tggacacccagtcttgttctatctcccagacagagtgcagtggcatgatcatagatcattgtaacttcaaactcttgggctctatcctcccatctcagcctccccagtatcccagctactctggaggctgaggcaggagaatagcatgaacccgggaggcagagcttacagtgagctgagatcgcgccactgcactccagcctgggcgacagggtgagactccgtctcaaaacaaac

SEQ ID NO: 966 - DNA, 598 bp, Homo sapiens
tagagacagattctcactctgtcacccaggctggagtgcagtggtggatcacaactcactgtaacctcaaactcttgggcttaaggaatcctccctcctcagcctccgaaagtgctgggattacatgtgccaccctgcctggtcactcttagctaatttaacccttaactttttttaacccttagactttatccttgcaccgagtatataaaccccttagccaaactcacttaaaaaacccaaatgtgtgctcaaacttgcttgatgataaaaactaaagaacttaaaggaatgaggatgatgaaggccattatgccatgatacacaattatttcaaatacagtgggcaacaccccatgtcattccagaaacccacctttctgtagtttttcaagtctgtgaaaagcattctttttagaatgctatgaatttaaggaataatattttgtaagcatctaaaggtttggtgaagtcaaaatcagtattttttttaaagtctaaatatttatccaaatagtataaggcttgacatcgctttatattattggaccaagaggaagactttttaaaataaacccattaaaaagttttaaacata

SEQ ID NO: 967 - DNA, 325 bp, Homo sapiens
aagcaatctccaggcagtatagtatagtggttaggattgcaggcctccatgccagactggatttaattttcagctttatcattgaccaactgttgatcttggggagttaactaattgctgcctcgattttctcttttatttttattttttgagacagagtcttgctttgttgcccaggctggagggcagtggctcaatcttggctcactgcaacctccacctcccaggttcaagtgattctcctgcctcagcctcccaagtagctgggattacaggtgcaagctaccatgcctggctaatttttatatttttagtagagatgcgg

SEQ ID NO: 968 - DNA, 1372 bp, Homo sapiens
ccctctgttttagtaaccacagggaaacatggcggcacggggtaagtggtagaaatatctattatatttaggaaccatatcacgaacttagcctgtgtttaaaccgtagcctctcccttttaataaacagatcacaaatatggcaagtggcattgcctctcagatcacaaatcgagcacacggctaagctgtgcaatgtgacatttgttagattcaattatacatcctgggcctcatctttttaaatttatttgttgcttatgaaattttaattagctaaagaaaaacaaacactttataggaaacaaggtaacagaggccataaagcacataaaccaccagccccataggaaggcactttaaaaagatagggtaggagatccacatcttggggaagtttacagagtcaaggcagagaaaactgtagaagaaacacaccgaccccactagagttggcactgtgagggcatccgagcagccatggggtagaccaaggacctttccttgtgaagctcttttgtcctcgtgaatcattatatgtggggacagctgggagttataatttggaatattgcaaagcaaatatgtacttctctcactttggggtatattcctgcctgttggtgttagactcggctaggtgacttgctttgggcaatgaggtgttagcagctgtggaatgagcagaggcaatcggtcatgacctcttgcaccaaagacatctcaatgagaaaaacttgccttgagtttctgctgcctggacctagaatgaatacatgagacagacctgacccaatttcctctagaagcagagcctcccagctgagcccagcctggatcaaccgggtctccgcctacctgcggatcctggaacatcagggtcaatgcttcttgtgatatgtcactgaatttgggggtggctgcaacctcattgtgcaacattaactatcacccttgcaatttccaagggcaagagtaacgacacgatgggggcagggagcagctccagggaaaaggctgcacaggtggacctggatctggagtggaggtcaggtccaatgaataaaagggaggaaaagaccttgcatctctgcagtggtgcaatcgcatctctgcagtggtgctgactccaggttcagtgactttcaccttcatagagaaacagcgatgaaccgcctttaagggacttatctgtattccatgctctctgcacattcaggaactgtttctggctcactgagactcattctattttatggcaaattctgtcccattatttctctctgtctctttttttttttttttttctgagacagagttctgtcgcccaggctggagtgaaactccatctcaaaaaaaagacaaaaaaaaa

SEQ ID NO: 969 - DNA, 580 bp, Homo sapiens
caagaaactgaagtggaaattacccttaaaaagtcccaccagctgggttgagtcagaatcatgtcttttcctgttgaaatctattccttctggtggagagtatgattctaaaattaacgttaagctaatttaaagcaactgaatagcttggaatgaacatgccaagccttctcattgttttatttttcagattgttcccagatggggtaaagttatggcttaggcagtggtacaggagacaaccagggcccctttttccaggagccctttgtctgcccgaggcatttgctgggtatagtggcctagtttagcaggatttaagtgtgcattcaccttcattcttatgtgtggtttgcattatttaaggagtagggagaattttttttccaaagcatgaggttccagttagactaatatactgtcaaattgagacctcatggtgttagttacacggcagggtatgaccacgacttgctgaggagccagcctgggtgtcgatcactagtgtggcacataattgctgtggtggttgatctggggcacagcactgcctgtaccctgtctcctgccatctgtctta

SEQ ID NO: 970 - DNA, 353 bp, Homo sapiens
tgttgtaaactcagaaaaataagggaaagcaagagggacagaccaaatgctccatttcttaggccttcttccccacttttttgaaacaaatacaaaatactcctctcattcattttctcctcaaacacaaattaacttttaggcatctattattgtgcaagaaagtgctaagcaagacacaatattatttttaaaatatggttcctaaattcaaacaactgaatctggcaggtaaaaggcacctactcagatttctacaatgcgaagcagaatgcaggggcatgcaaacagttcacacagactgcaaaagtctttaggaatgaagagtcacatctgtatccacatgtgaccta

SEQ ID NO: 971 - DNA, 345 bp, Homo sapiens
ttgcattagagataatcgaaacacattccaacacatacagaattgtattcactttagtgtcacaagagttcaattctaccttaaaagtatgttagcactataaagctgcaaatctgattttaaagttagaattcaagtaaagtttcattttccttttttaaactaaagattactacatactgcttccctgcagatatttggaaatgtgtgtgtacatgcaaagacagttgaaataattttttattgatgtgtgactctgaaaataaaaataatgatataacaaatttagatatacttggaatagattgggccccatccttggtcacaccatctaggctgttggca

SEQ ID NO: 972 - DNA, 327 bp, Homo sapiens
atatttctcggttcagatttatggtttctgtctcctacaggggttctggcttagagcattcttagtttcaattattgtatgtttgagttgttattcttcccagttgtggggtaagattctcagtttgattatgtattttcttgaattattacatttttgttaaagtctctgtctaaaaactgcaaaatctagatcccatggagatctgtttctattgtcttatttttcatgttattctatcttgtctatgggcaggcctggcacatttgtgtcgaatgtctgagatggtgcatggaaagcattagaaggtctggatgaggctgtctt

SEQ ID NO: 973 - DNA, 419 bp, Homo sapiens
ctctcctggcctgagcatcttatgggcagagttaaggtcctaacacccagctcactctcctagggagggcatgggaaaagaatcagccttccaagtaaattcaatgtagggtgtgtcactaacattctattttggccagcacggtagctcatgcctataatccaaccactttgggaggctaaggcaagaggattgcttgagcctaggaatttgagacgagcctggtcatcataacaagaatctttttttttttttttgagatagagtcttactctgtggcccagactggaagcaagactccatctcaaaaaaaaaaaagagagaaggaaggaaggaaggagagagagagagagaaagaaaggaaagaaagaaaaagaaagaaagaaagaaagagaaagaaaagaaagaaagaaagaaac

SEQ ID NO: 974 - DNA, 444 bp, Homo sapiens
atttctaagacttgttgcgcatccagacatagctaaagggtagggactgggaggaaaagagccttagaaaggagatgtgggagaaggaaacaaaagcgggattagaaaggtgctgaaaagaaacccacaggggtgttaaggggagagcaggtatgcagagcagaggagagcacctggcatttctgggatttggattacctgaattttgcttgatagttcatcttatgatttctggtggttgtgaaatgtaagctttgtgtgctctgtaattctgtgcagcaacaagatagaatggcacaggtctactcaggtgacagccaacctttcttttgtagtaaggaattagagtcccagtgttgaacacctaatcctctcttcccttgagggctgtaaaaatggagagagagacctgcacatcttgccatctgccacaaggcatttctt

SEQ ID NO: 975 - DNA, 308 bp, Homo sapiens
cattttagtatttatctctaaaagatatggactctttaaaaaaaaagtgtgaccacatgatcagaacaaaaaaattaaaaccgagtcctggtgctcactgaggtctatttacgctcagagtttaaccctgcagccccacagagctctgttgaacatttggaaactagtcttttaaagggccgggcggtggctcatgcctgcaatcccagctctttgggagaccaaagtgggaggatcacttgagccaagagcttgagaccagcctgggcaacatagcgagacctcatctctacaaaaattcaaaaatt

SEQ ID NO: 976 - DNA, 538 bp, Homo sapiens
tttcggccgggtgcggtggctcacacctgtaatcccggcactttgggaggctgaggcgggcggatcatgaggtcaggagattgagaccatcctggctaacacagtgaaaccccatctctactaaaaaatacaaaaaaattagccaggtgtggtggcgggtgcctgtagtcccagctactcgggaggctgaggcaggagaatggcgtgaacctgggaggcggagctggcagtgagctgagactcgtgccactgcactccagcctgtgtgacaaagtgaagactgtctcaaaaaaataaataaataaaaataaaaataaaataataataataataataataataaatcatccctttccaccagacagcaaatcagggtgtgaaccatgggggacaatgtcacgggatttggaggaacaagccaggcctcagaggagccaggcttctaagtggtcacctgcgcagcaacaggggagtcgactcagtctgctcctgcccccagcaaacaggcctcagagcagtcgcccagaccaagatgatt

SEQ ID NO: 977 - DNA, 424 bp, Homo sapiens
tagtctgcttctctctcctttcttgcactgcttcacacagccatgccctgccagcccgggcaggtgccttcctgtcaatgtacatttgggcttctgctcatgctgccctccctcccctcccctgcctcccaaccccgccccttttgttcctccatggagtacttccatgggtgtgcctcccccagccaagccataataggtggtttccccttcgcttctgtagcccttgcagacatcctctgtttacagtaggtgttgacttacttcccctctccccgctaaagccataaactccttaaggacaggtagcatttcttagtcatcttcgtttccttctcaatgaccagtagaccattaaaacatgttagctaaacaaatgtgaaatgattttgtgatgcacacagctaactaaagtacttccacc

SEQ ID NO: 978 - DNA, 997 bp, Homo sapiens
gggaggggtaacaaacttttgcttcagtgggaggaataaaagcaaaacttatctgcttctggtgaggtgtcaaaaccttcttgcccttcttgaacaggcaaagacccattgctcctgggactagaagcagaaaccccctacccaggggcagaagcaggaaactgtcctgggctgaagattcaagcgaaggtccactctgttgtggggagggcaagaactttggctaatcccagatgaaccacatataaggcagagtttggcttccatagggaagagggacagaaacactgagaaagtcccactgctgaagctcgggtgcctaggacctatttaagactgaagccgggccagggtaacagaatcaaccctgccctgccctgcctgagcctggcaccagatcacaagcaacagaagtcttctgccagctgaaaagctgagtgtgggacagcagcactgaggaagccctgacaccccagtccccactctaagcagcccaccactagaggaatttgaaacctggggtgcactgaaggtaatgagagcacaaccaaacccaaaccctgtccaattcctaacaagactgactcaaccccccagaccaacaggctgacagaagaggcagccccactcccagatacagatactatttacctcagtctctgctgttttatacaccatgggcattcagttaaaaaactgcaaaacataggtcaggcgctatggctcacacttgtaatcctagcactttgggaggccgagacaggtgtatcacctgaggtcaggagtttcagaccagcctggtcaacatggcgaaaccccatctctactaaaaatacaaaaattagccaggtgttggtggtgtgtgcctgtagtcccagctactccacaggctgaggcaggagaatcacttgaacctgggagggtgaggttgcagtgagctgagatggccccactacactccagcctgggcaacagagcaagactgtctcaaaaaaaa

SEQ ID NO: 979 - DNA, 415 bp, Homo sapiens
aaccttagtttcttcttcctgtttttccaactggagagactaagttcacagctgtttccatctctcatttcttcacatgactctgatttatcccattttcacagtaccttcctccctttggtgttgtagtatatgttgttgtggaaacatgtaaacacagtgacaatacagggagaagagaaaaagtggaaaaaactgttacataagatcagccgtgctctttagccagcataaaatgtcttgagcaatgacacaggccttgggctatgagggtgaactaaggcctaggcagtgattctgaagcaaatgtttccattgcgaaaatcccgggcaggcccctggaggcagagccctggttccacgtggcccagccgtctcctgagagcggagcctgccttccatcctcctgacactg

SEQ ID NO: 980 - DNA, 456 bp, Homo sapiens
caccagactgaagctaaaaagtgctggaaaacagcagttgctttaaccacaggctgtgtagaaccacctgaggatgaccctgggggtctgttttgtgcaccttggaacccatcggatccctcccaatgacacatttgtccagagcaagacaagatcacactttgacagccctctgtcaagatccttgctccaaatctccagactagcagccaggagtctccatgctgttctgaagaagcagattcctcacccacccttcaactccttcccaggaggtaatcctcctccaaatctctggaaaagatacacctcctcttctctgataaaggctggggggtgatgcccctcccccagtttcccaataaagctatgcaagacaggagcaagggatctcacggcctgtttttgctacaaaaaccctttttcggaaaaaataataaagaaaggaatcagcca

SEQ ID NO: 981 - DNA, 373 bp, Homo sapiens
taatgcggggtcgtggtgcccctggaccatcgggattccttcatgacacatttgtccagagcaagacaagatcacactttgacagccctctgtcaagatccttgctccaaatctccagactagcagccaggagtctccatgctgttctgaagaagcagattcctcacccacccttcaactccttcccaggaggtaatcctcctccaaatctctggaaaagatacacctcctcttctctgataaaggctggggggtgatgcccctcccccagtttcccaataaagctatgcaagacaggagcaagggatctcacggcctgtttttgctacaaaaaccctttttcggaaaaaataataaagaaaggaatcagcca

SEQ ID NO: 982 - DNA, 466 bp, Homo sapiens
atattacattttaatgtgaattttcattgaaatataacttatgtacaacaagccataaatgtatgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaactgtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgtttgacagtatct

SEQ ID NO: 983 - DNA, 295 bp, Homo sapiens
ctcagctggtgaggagtggagagggccctggagacagacgctgcatgctcttggaactccgtgccgggagtgttccagaaggttccgggtgagccgtcgaggacatggccctgacaggcagcggctgggtctgcagctctgcatggcgctgacccctcccgacctcgccccgcatccccactgcggtgtgggaggtttcacctgggtccttcacctccgcttcccagggaggagctcagctccatgtctggggcaccccggtccgtgcagtgtgggtcccacacatgcaggtgta

SEQ ID NO: 984 - DNA, 823 bp, Homo sapiens
ctttacatacttactttcttgattttctatggaaccttttctattaatttttatacttcgaagaaacctgctttataagagaaggcccggcagtggagggagcatttcatcgttttcccatagatgcagctgagatggagggagacccatccggaagccgtggagagagcgtctcctcagcccgccctgagacgggggtcctcctctctcccccatggtccgggcttggcttctctgggctgtgagatgcacaagtgaaacgcttcaatctccaaggccagagaccttccacccacaggcctcacgctccttcctgccacccgcttcccatcgcagctccttgctcctcagcttggctccaacagccccaagtccctgcctccctttccctgtcatcctcgcctggccgtgtcaggccgtgaagccgggacagaccacactgctctgtgcacaccccgggcaggcaggcgctgggcagcaggttgcagatggatgtggacggcgccaaggacccccactgggtctgtcttcccaatcgtggcctctgctcttcttcccctctgctgagagcctctgctcagcattcagagagggaaggtgtgggtggctgcctcctgccccatgccccccgccggggctccacctcttctctctcctggagcagttggtgttctcagggaaggtcctcgctcagtccacgcctggcaaatcccacggagaggcccggaagcagttccctccatggccactttcctgccagcattcttttcttactcatcatcttatgctgttactgtctccgcaactggaaccaacggtcctc

SEQ ID NO: 985 - DNA, 424 bp, Homo sapiens
cacaaaacacccttttaataatttcctgacgccttcgagaggtccccattgctctggcgactgtcctgacaagcccacctcccatctctcacccaggtccttctaaaaatctcagcctggtgggctgtttgtctctgggcacactggtgcccagggcattcctgcctcttccctcctagacaagtcatctgtgatcatcaggacattctcccactaactcttgcaagctcacttccctttcagatgacatcactgcctcacactcatctctcccaatgataagtctattacgcaaaaatgtattactcatcaccattttttgagatggagttttgctcttgtggcccaggctggagtgcagtggcacgatctcggctcactgcaacctccacctcttgggttcaagtgattttcctgcctcagc

SEQ ID NO: 986 - DNA, 540 bp, Homo sapiens
attcccagaaagctgtgtcagcaatgagatttgtttcattgttttgccttgttttgtcattgagttgttatagttaaagtttattattttttaatgcagaaaaaagtgacttttgggggagtgcagagttctatgaatttttaacacatgtctagttatttgaccacaaccgtaatcaagatacagaacagttttatcatttcaagtgctctcctgctatgcttttataacacacccttccccaccccaactcctggcaattactgctctattctccgtaactgtagttttgccttttcgagaatatcatataaataatcatgtattatgtaacattctgagacaggcttctttcacccagcataatgcctttgagattcatccagatcgttgtgtgtatcagtagtttgtttttattactgggttatagttcattgtatggatataccacagtttctttagccattcacccactgaaagtcatttgggttgtttctaggctttggtgattatgaataaagctgctatcaacatccacgt

SEQ ID NO: 987 - DNA, 192 bp, Homo sapiens
aatgaactattttataaaataagtaaatttgaaggggagtgtgttcttaaaaagtatgtgtactttattaactatttttaaagatgcaaccttaacatttgtacatggtttccttgttcatgatctaactccctcgtcagttgtgtaagctgtaggcttgtgctgaacttgccttgataaaaaggggtgatt

SEQ ID NO: 988 - DNA, 349 bp, Homo sapiens
gaaattacctaattaccataaagacagattctgtaggatgaaccaatgagtgagggcagagcttcacctatccccctatcaaccttctgagaagaggccagagacagcaggcagggtataccttgcaggctaaccccattctgttggaaatgaccagctgcagtgctgtgccatgatgaaagggattctgaggccatgttggagtgcagtggaagagcatgccctgattgattattgatgtccatcatgggaatggtattagggaggagtcagggcacacacttgccctatattcatctccctctgctaggaaataagcaaactgaaattcaagttttaaaacaaggag

SEQ ID NO: 989 - DNA, 348 bp, Homo sapiens
attaaaatatatagaaatatatcaagacaggtaaatgtaaaggctttgcagtctttataacctgtgttaaaagttctctttggaaataaaaactattactgggacaaaaaggaaaacttggtcatttaaaatctatcttctaaggaagggggaaaatcctggttttaaatagcccatctggccttcgaaagcttttccccagggagctgcactaacttctgccacatagatcgtgcttgatgatggacatagcccatggcaaagaggccagagatggaaagcaaatggacttctgtgaaaatacacgagggacaaacagcatcctgcttgcccagtaagtgctagaaa

SEQ ID NO: 990 - DNA, 1161 bp, Homo sapiens
  misc_feature (22)..(22): n is a, c, g, or t
tactgggaatagtggcttttgnccatgacatctgctcattcttcattcatgtaatgggtcaaatccgaagtaattctggagatacggtatggtaagagaagggcctaaagagtctctagagattagaaagcatatgccattgtaaggaaggatggggagagaccgtgcccagattaaatggactcagccatttgacttaatgggatgcactgcccatggtggcaccctcccctgggagttcttccttgatcttgagactttcccaaactggaatccacttagctctgccacatcggtcccagatttggtgggactctcctctggtatcagttttcaacgccacttcttgtttggagtcattcccagtgcagtcatggactctatgaacaaatacggttatttaaatgtatttgtccagtatgagaatcagaatgaactagtagaggctttacagatcagctggtctgacccattttacagatgaggaaacaggcctgagaagatggagggagttacccacaatctgaaggggctctaccatgactagacccaggtcacctgcctcccaggcctggctctttccactccgaggtgctggctcaccacagacttattctttaatggaattttggaaaggcctcactccagtgactctttggatctttcttctctaagtagatgggaagcctgtaagaagagacttggaggcaaagcaaagggaatcagcacttaaccctcacccaaagggcccaagagaatctttagtaactggaggcagagcagactggagcctctacggggcatctccccatattggagaattcagtctttgttttggaaatcttataatgtctttggagaggctttaaataattttgtttttcttagcaatgttatgctctattttgagacatggattttttttttcttctagtgtttctctcctgagcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatgaa

SEQ ID NO: 991 - DNA, 443 bp, Homo sapiens
gccttgtggctgcctgtgctggagtccagccctctgcaggtggctccaacaccaacgtcacccacaggcactgtgtttataagctgagtcctgcaaactccagttccctaggtgtggccaggatcgtgaacaagcagcagaggatttaaactaaatgcttagcctgtgttcctctgcaaataaaggcttcatgcccccaaaagaaaccttccaagaagaacccttagatgggaacaagctaagtgtctgtgcttgggttctgctaattatgagagcccttgtcctgatatcactctgagatgtggaaagttcttcttacccaaagcacaatcctgtatccctatgtctccccctcttcctccccatccccatcaacactcacacagcagttctcattctcttcttctaccagagctcagccttccccaagaggaagtgaggct

SEQ ID NO: 992 - DNA, 354 bp, Homo sapiens
taacaaaaattagaaaatagcttaaaatatccagcattcagaggataattacattatggtatgctcatatgatttatactattttctaacattattttaatggcatgggaagttgctaagtgaaaaaaaaagatacagcattttatatgtagttgatctaaattttgtaaataaataaatgaacaaatgctaaaggaatttatttcgtcaataaatagtaaactcataactgctttaaaaaattataggggttctctgggtattcaagaaatattaacaggccaagcacagtggctcatgcctgtaatcccagaactttgggaggccaacatgggcagatcacctgaggtcagg

SEQ ID NO: 993 - DNA, 1848 bp, Homo sapiens
agccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 994 - DNA, 486 bp, Homo sapiens
cgtttaggactatgacagtgttaaaaacaggtgtacgcccggaattccggatcaggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 995 - DNA, 2171 bp, Homo sapiens
  misc_feature (2014)..(2014): n is a, c, g, or t
agccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaaacaccaaaaaaaaaaaaccccggggccctttttggggggggcggaacaacggggtattagacagggccagggccaaaggtgttcccccgcacccccttttcgttccacgtggggggaaacgcgcggggccccatagggggggcgaaaattgcaaaagcggtacgantctaggaggacacagcaagcaaaaaaactcaaacaacaaaacaaaaaaaaacaaaacaaagagacaacaaacaacacaaagatcaagcaaacatcacaaaaaacaacataaaaaaagaaacaaaaacaacaaacaacaatcagcaaacagacaacaa

SEQ ID NO: 996 - DNA, 1932 bp, Homo sapiens
agccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaattaaaaaaacatggctacaaagagggcaaaccgtgcattattataaagctcaaccgagttctaggcttccctgcctcccatggt

SEQ ID NO: 997 - DNA, 1799 bp, Homo sapiens
taggctaggtagaggccgtggtgaatcggccgagggcatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 998 - DNA, 1772 bp, Homo sapiens
aaagcaggctgtactggtcggaggttttctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 999 - DNA, 1774 bp, Homo sapiens
gtcgcggtgtctgggatatagctgccatagtgcgtgagctggctggtccgacatggagctggcggagggccttggcgtgagcgcgacatgcgtggatgatgtccgggtgtggttcctgtagggccatgtgtcgtggacaaggggggcgacgagggcgggtgctccgtcatccatttgaccttggtgcttcggtgtgggcttgatcactactggggcaatacgtgaatcggctggtccagggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 1000 - DNA, 1512 bp, Homo sapiens
taggctaagtggaggctgggggtgcatctggtcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 1001 - DNA, 1528 bp, Homo sapiens
gccaccccctctgcctgctgcaatacagcagtattgctacttacccataactcatgggagggtggggagggcacacctgagagggaagtctgggctcaggcctctcccccgactcactgtgtgtctaatctgtcaccagatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 1002 - DNA, 1327 bp, Homo sapiens
taggctaggtagaggccgtggtgaatcggccgagggatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 1003 - DNA, 1572 bp, Homo sapiens
gggaggggaccgagttgccttggtagctcatgggctggttgggggacaggactcctcgactgtagcagggtttctccaatctgtggggtaacccgcatcagaacatggtggcaagtacttacaaaacatgcggctctccagcgggttcttgtcacgcagacattctagcaccattgctttcaggagaagagcatgggcgggcgctgacaagagtttaagagctagagggaagacgggggatggaaggaggggtcagagaaagggagggagctgcagctcaccctgttctccccactccccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 1004 - DNA, 1279 bp, Homo sapiens
tcaggctagtagggccctgtggttatcggacgagggtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 1005 - DNA, 1606 bp, Homo sapiens
agccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 1006 - DNA, 1507 bp, Homo sapiens
agccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 1007 - DNA, 1370 bp, Homo sapiens
agccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcctaccctaatttttggtctatgtatcgttctgttaggataaagtctatctgatggcccctgtta

SEQ ID NO: 1008 - DNA, 794 bp, Homo sapiens
accacctcatctgccctaccaccttcatctgcagctcccaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 1009 - DNA, 1333 bp, Homo sapiens
  misc_feature (1247)..(1247): n is a, c, g, or t
agccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtggtganttggtaagtgtgcttctgacttgccatcatctgagtctgctgttcccattcgctattggaggagaccaccagaggcaggtccggct

SEQ ID NO: 1010 - DNA, 1248 bp, Homo sapiens
agccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctacccttacccagaaagccctcagattcatggactgccaatagacttggcatgcctactgggggaccgaatggcaaatctttgttcccgaaaaagggcgttttttttccttggctttattttcgggttttggggcccacataggggccaagtttttgcccca

SEQ ID NO: 1011 - DNA, 804 bp, Homo sapiens
agccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcacttcgccgacaaccagctttttgtttcgggccccaatggcacagccggcatctttgctacctaccccttctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 1012 - DNA, 2857 bp, Homo sapiens
tgcatttctcctctgtgctcactgccacacacagctcaacctggacagcacagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcatggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgt

SEQ ID NO: 1013 - DNA, 2212 bp, Homo sapiens
tgcatttctcctctgtgctcactgccacacacagctcaacctggacagcacagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcatggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaata

SEQ ID NO: 1014 - DNA, 1013 bp, Homo sapiens
cctggtacggtccgaagtcgtaagatcaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgt

SEQ ID NO: 1015 - DNA, 2786 bp, Homo sapiens
ggggaagccactgctaccctcatcaggaagggcagacacaagaagcaccagttctatttgctgctacatcccggctctcgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcatggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgt

SEQ ID NO: 1016 - DNA, 2839 bp, Homo sapiens
agaggctgtacggccgaatttgggatgacggcaagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcatggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgt

SEQ ID NO: 1017 - DNA, 2781 bp, Homo sapiens
tgcatttctcctctgtgctcactgccacacacagctcaacctggacagcacagccagaggcgagatgcttctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcatggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcacacaacctctcctctgagtgctcggcccccagcgaccccctggacatcctgatcacaggacagatccgtggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgagtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataatcaatgagttaaccgagaaaactaaaatcagaagtaagaatgtgctttaaactgaatcacaatataaatattacacatcacacaatgaaattgaaaaagtacaaaccacaaatgaaaaaagtagaaacgaaaaaaaaaaactaggaaatgaatgacgttggctttcgtataaggaatttagaaaaagaataaccaattattccaaatgaaggtgtaagaaagggaataagaagaagaagagttgctcatgaggaaaaaccaaaacttgaaaattcaacaaagccaatgaagctcattcttgaaaatattaattacagtcataaatcctaactacattgagcaagagaaagaaagagcaggcacgcatttccatatgggagtgagccagcagacagcccagcagatcctacacacattttcacaaactaaccccagaacaggctgcaaacctataccaatatactagaaaatgcagattaaatggatgaaatattcaaaactggagtttacataatgaacgtaagagtaatcagagaatctgactcattttaaatgtgtgtgtatgtgtgtgtatatatatgtgtgtgtgtgtgtgtgtgtgtgtgtgtgaaaaacattgactgtaataaaaatgttcccatcgt

SEQ ID NO: 1018 - DNA, 358 bp, Homo sapiens
ggttctaggaaaaaggaggctggtattccttcaacttctcaatttaaaaaacacagacaaacgccacagagaaagccccccagcagatgctcacaggcagcacttgctcagcccggcatggccagaaatgaaggaagttgtcgagcagccaagcgctgccggctgcgggagaggagtgcgctcagtagccaaagaggatattaagtgaaacattaaagctgcagatagaaagcggacatcccctgggaacagggattcaacatatcactgccaccaccacggtgcatgccctgtagctggtttctattaagagagaacagagcattcaccgtctctaaagagggatatgttcactacc

SEQ ID NO: 1019 - DNA, 386 bp, Homo sapiens
gccctttcttctcccttcttgtctttgtcctcctcttcacgtcactctggcccttctctgttttttacttggtgtggctctatgtggactgggacacacccaaccaagtatctcattgtccgcaggtggaaggcgttcggagtggataaggaaccgggcaatttggagacaactaagggattatagccttgagccaccgcgcccggcctgggagtggatgatgttcaagagcggggccttggtggggcaccatggctcatgcctgtaatccaagcactttgggaggccgaggtgggaggattgcttgagcccaggagttggaggctgtagtgagccatgattgcgccactgtactccagcctgagcaacagagtgagaccgtctct

SEQ ID NO: 1020 - DNA, 583 bp, Homo sapiens
aaggcctgttgctactgtgtgatgcctgctccctagatgacctcctgggggggtgaagcgagaggaaatctggcaccaagctggttgaggggcagagcgagaatgtctgggcttcccccacccagcttggaatgtgagtgatgcaaatcatctcatcgaaggctcaactgcagccaggagactcctccagtgatgatgagagtgtacaaatgaagtgcaggagcgggggagccttcacacacctccagcccttcctgcttcttgaaatactcatatcctctggcagagactagctacagaaatccatgtccacttactcacagcctgaaagaaacccacacagtggaccaggaaggttgttgcatggtaattagagctactattgaatttctattgtgcatcttctcaattaggcacaattaccacatataagaaatgaggaaattaagactcagaggaattaggtgaattgcccaaggttattacatagcttatacctggccaaccagggtttaaacattgttctatatcctaatccaagacccatgttcctctcactactcaggtttatttctttcgcact

SEQ ID NO: 1021 - DNA, 444 bp, Homo sapiens
gtgaggtcttttttgactgacaagcttgaaaaaatggtcaccagaccaccaccctagcccccttttctgcttaactttttagcatctatcaccatttaatggaaaatacttcattataaatcttttatttccatgaggataggtaattatttgttgttgggggtgtctttgtcagcatctagtacagtgcctggcagatggatgctcaataaatattgatttaatgggttatgagggtgttaatataaaattagcatttattcagcaactactatgagtcagccactgggctaagtggcttacatgttaagaacctcacagaaggccaggtgtggtggctcacgcctgtaatcccagcactttgggaggctgaagcaggcagatcacctgaggtcaggagtttgagtccaggctggccaacgtggtgaaaccccatctctacta

SEQ ID NO: 1022 - DNA, 1330 bp, Homo sapiens
gcctgaagtagaatattttagaaagtaattaaaccttttttcagcataataacccagagatgtacttctgaaggacttaggatctcttcttgaaaggcaagcaacaagggagatagtacctgtaagtcagtaggaaattaaatatttcaaacatcagctatttcaaatttaaagctacagacttttaaataattcggaaccttgagaggaacgtggtcatgcaacctgagtccggtggcatgcaggcgcaacttctacaagttttcctggccaggcatgcaggctcaggcctgtaatcccagcactctgggaggctgaggcgggcggatcgcctgacgtcaggaattagaaaccagcctggccaacatggggaaaccccgtctctactgaaaatacaaagccattagccgggcatggtggcgcacgcctgtattttcagctatttgggaggctgaggcaggagaactgcttgaacccaggacgtggaggtcgtagtgagccgagatcacatcactgcattccagcctgggcgacagagcaggacgccttcccaaaacaaaacaaaacaaaacaaaatgtgctatacaatttagtttcctaatatcaattttaaaaagttttcgtgtaaataattaggaaaactaagcagccccagagataagacctcctggcatcattgtcccttcttatggagtgataatgtaaccttccttgaagtgtatcactccatcaccagtcaagctgccgcagcctatgcactggacttgaatggaaaatgtggtggttctgggaaagcttctctgtatttccttgtgtgtgtgaaatgttaatgtctctacttgggaacgctgaccccattcatttggagttgaggtttccaggtggctattctcatgctttgtgtccaaataaactctataattaataatgtattctaaatttcattatttactgctgacatcagtttctgttggattgtaggagcctcaccagagagggcacctgtccgccatgctgtaaaactcacacttgccaaaaatacatgggttagggtttctccccctccctcaggatgatgctagttagctgacacagatggtcacctccattaccaagtagagccaggatgaattatgtgtgaccaagggtgttgtcaagtcctcttccctgaggactgatcagtgtttatcttgaaaacatgtatttgggttgtatagaacagtgaagtttctttctctcttttcaacctctcaactgtcctctatttcccatcacatgctggtctaaggcctatttattaataaaatagtttttatttctttctctgtta

SEQ ID NO: 1023 - DNA, 1237 bp, Homo sapiens
aagaggctgaggcagaagaattgcttgaacccgggaggcggaagtttcgatgagccgggatcctgccgttgcactccagcctgggcaacaagagcaaacctctgtctaaaacaaacaaacaaaaaggtctagccccctctcctcctttgtctgccatcatggtgtgtgcttgactccacttcttgtcatgtcttctcacaagactttcaggattaagcggtttctggccaacaaccaaaagtaaaatcgtccgatttcccagtggattcgaatgaaaactggcaataaaatcaggtccaactttaaaaggagacattggagaagaaccaagctgggtctataaggaattgcacgtgagatggcacacatatttatgctgtgtgagcatcataatcacgttacttaaccgagatcacatcactgcattccagcctgggcgacagagcaggacgccttcccaaaacaaaacaaaacaaaacaaaatgtgctatacaatttagtttcctaatatcaattttaaaaagttttcgtgtaaataattaggaaaactaagcagccccagagataagacctcctggcatcattgtcccttcttatggagtgataatgtaaccttccttgaagtgtatcactccatcaccagtcaagctgccgcagcctatgcactggacttgaatggaaaatgtggtggttctgggaaagcttctctgtatttccttgtgtgtgtgaaatgttaatgtctctacttgggaacgctgaccccattcatttggagttgaggtttccaggtggctattctcatgctttgtgtccaaataaactctataattaataatgtattctaaatttcattatttactgctgacatcagtttctgttggattgtaggagcctcaccagagagggcacctgtccgccatgctgtaaaactcacacttgccaaaaatacatgggttagggtttctccccctccctcaggatgatgctagttagctgacacagatggtcacctccattaccaagtagagccaggatgaattatgtgtgaccaagggtgttgtcaagtcctcttccctgaggactgatcagtgtttatcttgaaaacatgtatttgggttgtatagaacagtgaagtttctttctctcttttcaacctctcaactgtcctctatttcccatcacatgctggtctaaggcctatttattaataaaatagtttttatttctttctctgtta

SEQ ID NO: 1024 - DNA, 1244 bp, Homo sapiens
cagctgcagtcgatctagagatccccatcagttacacaataggcgacctcaaaaacaaagggactgcctcctcttaaagtttctcttacataggtgcttaggtaaaaactaaggtatgtctacctgccagtgggctgacagtgtaacaaaacttattactatgttgatttaaagctatccttggccggttgcattggctcccgcctgtaatcccagcactctgggaggctgaggcgggcggatcgcctgacgtcaggaattagaaaccagcctggccaacatggggaaaccccgtctctactgaaaatacaaagccattagccgggcatggtggcgcacgcctgtattttcagctatttgggaggctgaggcaggagaactgcttgaacccaggacgtggaggtcgtagtgagccgagatcacatcactgcattccagcctgggcgacagagcaggacgccttcccaaaacaaaacaaaacaaaacaaaatgtgctatacaatttagtttcctaatatcaattttaaaaagttttcgtgtaaataattaggaaaactaagcagccccagagataagacctcctggcatcattgtcccttcttatggagtgataatgtaaccttccttgaagtgtatcactccatcaccagtcaagctgccgcagcctatgcactggacttgaatggaaaatgtggtggttctgggaaagcttctctgtatttccttgtgtgtgtgaaatgttaatgtctctacttgggaacgctgaccccattcatttggagttgaggtttccaggtggctattctcatgctttgtgtccaaataaactctataattaataatgtattctaaatttcattatttactgctgacatcagtttctgttggattgtaggagcctcaccagagagggcacctgtccgccatgctgtaaaactcacacttgccaaaaatacatgggttagggtttctccccctccctcaggatgatgctagttagctgacacagatggtcacctccattaccaagtagagccaggatgaattatgtgtgaccaagggtgttgtcaagtcctcttccctgaggactgatcagtgtttatcttgaaaacatgtatttgggttgtatagaacagtgaagtttctttctctcttttcaacctctcaactgtcctctatttcccatcacatgctggtctaaggcctatttattaataaaatagtttttatttctttctctgtta

SEQ ID NO: 1025 - DNA, 583 bp, Homo sapiens
aagaggctgaggcagaagaattgcttgaacccgggaggcggaagtttcgatgagccgggatcctgccgttgcactccagcctgggcaacaagagcaaacctctgtctaaaacaaacaaacaaaaaggtctagccccctctcctcctttgtctgccatcatggtgtgtgcttgactccacttcttgtcatgtcttctcacaagactttcaggattaagcggtttctggccaacaaccaaaagtaaaatcgtccgatttcccagtggattcgaatgaaaactggcaataaaatcaggtccaactttaaaaggagacattggagaagaaccaagctgggtctataaggaattgcacgtgagatggcacacatatttatgctgtgtgagcatcataatcacgttacttaagctgaaaatgtcactaccatctggagacttggacatgttttattgggaatatatttttttctctctgaatctgttatgaacgcattggttgggtgggttcagtaataaacatgtgagacctttcatttcaaaaaaaaaattttaatgacataatagattacctaaatttctgttttg

SEQ ID NO: 1026 - DNA, 184 bp, Homo sapiens
gacttggacagtgtgaacagagcaatgtcatcaggaataagactgagggagtcagcctcagccaagggaggaatcctaagaggaagaagtggaggctgagagctggtggcctccccgttccagccgcctcaccctaagcatgcgcagccccctcccttgcctgcacggaggagccatttgcagc

SEQ ID NO: 1027 - DNA, 588 bp, Homo sapiens
cctccaaccaaaagtctgaggtgcttccgaggaagcacttcccttgggtgggagcgggtggagcctggtcagcttgcccctgccagcccctgcagtgtcagctcttccaccccttcccattttcttggcctcaacgtgcccactgggctatgaggcagtccctcgcccccctgggtcctcatgaagaagcatttcagggtctctggcaggtagctgcaaagcttacttggggtggggtgtgaaaggcacaccggctgatggagccccaggtcatgttcatgcctgctgcaggcttcctcacagccaggagctgggggatgagtgcagggttgcctccgtgtagtccttatggagaggcgaaggagccagccgcagtctcttcctggccagactgacagagtactgactgtcaggccactcactaccaagaaaggtggagaccctggcagacagaggtattttgggtgataggagcaggctgagtccagggcctgaggacatggtgaggggaacagaggggagggactcagtctgccctctcttcctgggtactgaaggtctccacaacacaccccaaggcagcatgtt

SEQ ID NO: 1028 - DNA, 413 bp, Homo sapiens
aagaaaaggaaaggcgaatgggtttgaaggccatgagcaaaaggatgaggggagtatgggaatgggaagtctgagaagtatagatttttaaggggatcgcatagagacagtgagtctagtgattattccaagagttagtatactggatggagagtgaccaaaaaagaggatacagtgaaaagaaaaaagaagcatgaccttttgcacacattagatctttgcaatatttatgcaggtgtaattttatattttagtatgtaactaaacatactatgaacatcacctcatagttccacgttgctacagtttttataatttttttctttctaatgtttgtttatatgattatataatgattatggtatattaagtgcatatatcacttatcctatcataattcatttagttgttca

SEQ ID NO: 1029 - DNA, 782 bp, Homo sapiens
ccagctgctcgagaggctgaggcatgagaattacttgaacctgggaggtggaggttgcagtgagccgagatcccaccactgcactccagcctgggtgacagagcgagacttcgttcccaaaaaaaaaaaaaaaagctgcaaatttaaacgttgaagtctaggtaaatataccagggaacttctgcttaagaggcttctatgtaatgaaattctcttgaaaacagagaaactatttcctgtttattttctaaattgagacgtcactttttaaaaattggtacctgtaatttagccatttcctactcagcaatgtctcatttaaactattatttgtttagcgtgtttcaaagagcagatgtaagcttgagcccatcctctgtcctatgactaagtcgatattagcaggggttaggactgttagttttccagttcctactggaggcaaattctttgtttaccactgttctctgtatttcaaaagcacctggaaatcaataaaatttgttattcagaacaaaagccttctctatatatcagtatttcccaaaatgtgtttggaaatataggtatgttaatccaaagggatggtacgaggctgtattatttaaggaaatggtcccatagcttagcatgtttgggaaatccatttcttttctgcatttctcagattctttattacattaatataaattgtgaattttcaaatattttttctgaccagaaggcatactttccatccatcatcttgtccatggaacacactgccccacaacacaaattaa

SEQ ID NO: 1030 - DNA, 344 bp, Homo sapiens
aaaaatcaatttccaaattgaaatttgtcaaatagagaatactttctagttttgaagtgaaggtgcaatctattattctcaggcagaaacttggaaaatatctgtatgagagtttagtaaagatgataccagtactgattagaaatatttgtatttatactttactcatttcttgcacacctcagtgaaggaaaaatacagtaactaaaaccacagctctctagactcaactgtaaatttagtagtgatcaaaacaaaagaccctttagcaccagaataactgttgcaaattcccaacattaaggagaaatactttgtcctgttgaagacacagacccttaggc

SEQ ID NO: 1031 - DNA, 357 bp, Homo sapiens
gggagtgttaacattaaaaacatatgcttggtaccaaggagggagaaacacaaaagaggatcgcgatgcacatggtctctgtaaacaagtagtctttgtggaagttccccatgtgagggaaacagctttacagggtggtatgaagaaacttgcctgaataattctgacttcatctgcaagactgtttacctgacatgaattataatagcacattaccaagaaatgacatctgcagagatgatagctaattgagcttgtgtttatttgtttggttttgttttaccaattcattgatgaaataaaagcattagaaaatagtcaccatgatcatgcactcaatctttgtgtttgtagcag

SEQ ID NO: 1032 - DNA, 396 bp, Homo sapiens
cccagaaaacaactcctagttaaccttggctcctcttcactcggcctctgtctttaagtctgagtgacctggtgggattgatcagctttgaagtcctaaggtgctattttaatactgttcttttacgttgcaggcttcgagactgatttaactagattctggagggagcttactttacagcattcttaagagctcgaacaatcttgaaagagttaaactctaattagctcattcctaaggtatttaatgcccttattaaaactcaactgctcgttcacttttttctttagtgaatcagatttcttgaggagctgagccttcgctcctcagatcacaggctcacatgttgaagctggcagtgctagaggctagttcctatctgtgtgacagcatttt

SEQ ID NO: 1033 - DNA, 370 bp, Homo sapiens
agtagaaaattaatttattaaaagaatggttggttatgcctcgcgtgagtgacagagccagggttttgtcttctatcttcagggcagggtacagctgggtattggaattgtaccaagcagtgtttcccaagggggcacagagggagggcccctctccgggcactgtgcgggagccacttccccaaacagtccccgttctgcaagggccccggcgttgctgcccccgagacccgggtgcctgccccggcggtgcgggtcgcgggcctccgctctcgccgtcctccctcagtcccgggcctcctgcatcgcggtcgccaggcgcaggctcagcgcggctgacagcgctccagctcccgcgctcgcggccgca

SEQ ID NO: 1034 - DNA, 410 bp, Homo sapiens
ctgaatgtcttatcattttctttttgtctcagtaacctcacccctaaagaggaggtcctgtacaacaatacaaaggagaaaggcagaaaagggccaggagagaatgtggaggtgggagagaaccctgcatggtggagacattccttgactgttctgtaggcagtaacccaggccagtgtcatccaggatgtttctgaaattctgcttttacaagagagagctgtgtcacatatttggtgctcagtgactagtaggctatgtggccttcacacactatgaagctttgaatgaagctgagcctttataaatgtttagagtcaaaggaattaaaagcctaatgtaacctaaaagatcatccccaatccccttacattatggacttctcctctccctccccattgacgtctttc

SEQ ID NO: 1035 - DNA, 304 bp, Homo sapiens
ccttggctggtactagggtgcactaagtattttgaaaacaattttatattttcccagcttgattttaagctttcttagccaggaccagagaataatcattagtgtatgctaatttggccccgttactggggttatttcttttgaaaaatctgctagctgttccatttgttgaggaggcatttctgctttagctaatggaaacataaaaccatacttggccctctggggtgtctgataattttactgtctgctctctcccggtccttcttttccaggtctcaggtagttttgttacatgcagcct

SEQ ID NO: 1036 - DNA, 638 bp, Homo sapiens
ggctgtgaaagaggacctgaaagacatttgacacaaataacaggatggggtgaaacttcccagaagaggtggtatttttgcaatgtcttgaagtactcctggtgaagacattggagttcatcaggtttagaaaaggggtggaggcttactctagaaaaaggggatgccatctgtcaaaccactgtcaaaacaaggtttagtgctgacgtgttagatcttttaaacaatcagaaccattcattttttttctctgacgcctgccatcatctggtgatgggtttcttttctttccttcaaataaaatttattttccccctttattgtttcttgtcaggctgaattgatacacacacacacacacacacaaacgcacacatgtatatatatatgtatacatacatatacataagcatataaatatgtacacatgcatggatacatgcatatgtttacatgtgtgtatgtgaatagacattttacatatgtaaatatatatatatatttgccttgtatgattctttattacaaaataaatgatagagggacttaatgtaggaaataggaagttttgtcatgtactctaagcttttctactctcagtattttgggatttgcctgtcagatatttaaagaccatt

SEQ ID NO: 1037 - DNA, 463 bp, Homo sapiens
aacttttttacattgaaggtaacactacagcgaacatcctgtgcactcactgttatgccaggtgggagtatttctgtgaatacataactgaaagtggcattgctgcgttggagggcatgtacactttaaattgccctggtgactaccacattgcccgccacaaggcagcgccagttttcagccgcccattggcacatgagcctgcctgtctccttgtatctcggcccacacaggactgtccttgttaatttttgccaattcaatcaattttcaaagcttatcattttaatttacatgcctctgattgctaatgaggctttagcatcctttcatcagtttaatggctgttcatcaactgacatttatggtttttaagaatgcctttcaggccgggcgcggtggctcacgcttgtaatcccagcactttgggaggccgaggcgggtggatcacgaggtcaggaga

SEQ ID NO: 1038 - DNA, 321 bp, Homo sapiens
ggagagatttagctggaggtaaggctagtgcatgccacaaagtcctctatactttgtgaaatgtgagccatggtttgtctctgagcttcctggcaggcaataggaggaagggaatatatttggaacacattttatattcactagacaaaaggaatcccatttgtaagaagaaatgaacccattcctgatactgagggatgggaggattccgcccccaccccaatccttgtgaacattatcagctacaggatcagtcgttttctcaataagctctttgtagcacaggttttacaagctgcagattgtgacctgtggtgtgta

SEQ ID NO: 1039 - DNA, 1689 bp, Homo sapiens
tccatgtgctatactgtcctggttatatcacgtttttcacttcaaatccaaaggtagccacgtttttttaaagtttttatttatactttatcttattccattaaaaatgtatggcaattgataggaaatccactcaataaaatagaaaaataagagaaaaatatttaggataatataaattagaataggtggtattttgggggagggaatagtgtcaatgtcatatagatgagcaggctatgctgtgcagagttgttatattcagatagtttggttttgagcttcctgggtgctaaagtaaaacataacattattttttatgtactgttcattattcatgagtttgattagtgataataatagagtgtcatagtctttaactggagtagattacatttaaaaccaccacaccatatttggttaaaaaaaaatatcaaactagaaatttgttaacttgttaaaagtttatctctagtaatcatcatatacaagggtaaaatgctagaagaattcttttcagggatcaaacaaggataccctctacaacttctcttcaacagtattcttgggtgtcctagccagtgcagtaagacaagtaaaagtaatgagataaattggaaagtaggagcaaatctcattatttgtaagaaatatttacctagaagatgaaaggtagacaactgacaagctatcagaaccaatagagttgaaaaaggtaacagtacaagattaatatactaacatatagcaatattttatgggaaaaatggatatttatttataatagcaattaaaaatcacctagggaaagcctaacaagaaatatgctagagtcttatgttcttttttgaaagatagataagaaaacttcaataatggagcagaatatcatggccatgaatgggaaggttatattgtaaagaattcatttgaatcctgttttaaaactctcaataggacttagagctagtcaaactgattctaaaattcatgtgaaagtgtaaattcaagaatagccactacttaaaatggtacacattagatatgcccccatactatgcttaggaacttatacggacataccttagagatattgtgggtttggtttcagaccacggcaataaagcaaatatcacaataaagcaaatcacagaatttttagtttcctgatgcatatagaagttatactgtactgtagtctatagtgtgtttcaatagcattgtatctttaaaaatatacataccttaattttaaaatattgtcagaaaatgccaaagatcttctgagcccttagcaagttgtaatctttttagtggtagagggtcttgcctcaaagttgatggctgctgactgatcagggtggtagtttctggaaggttgggtggctgtggcagtttcttagcataaggcaatggactttgccacttgattgactcttcctttcacaaaagatttccctgtagcatggaatgctgcttgatagcattttgcccacagtagaacttctttcagagtttgagtcaatcctctcataccctgctactgccttacaactaaatttatggaattttctaaatctttgttgtcatttcaacagtgttcacagcatctccaccataagtagatccaatctcaagaaacctctttctttactcatccataagaagaaaccacttttactcatccat

SEQ ID NO: 1040 - DNA, 358 bp, Homo sapiens
ataacctctctgggtcttgcctacccagcctgtaataagcagcaacagtcacgcctcaccccaggctgccatgaggagtaatgacacagagtgacgatggctgggggcatgctttggaagtgctgtagtaggggtggcagagctccagctggccgagccccatctggtcaccccatcatgggcacgatggatcagtatatagacttgaggtcccttggctaagggtgagcctgggctggggtgcacccagtaacccaagcaaatctttggccaacaacccttggctgtccccagacagtcacctcagaacatcttccagagccaggatgggaacagggtgaggccttcaggacactgg

SEQ ID NO: 1041 - DNA, 519 bp, Homo sapiens
gctcctcagccagccttctctcctgacctctcctcagggctggtcacaagggggccgccccctggcccctcccctctcgacgtgcggcccccaaccccggattctgccctcctgcagtgatgaatggcaccgctgtcccgcgcaggcaggcaaacctcttcctgaaacagactctgctggaggcaacagcagcaacagattctacagaaagcccctgaaatggaggctcaggcctcacctagctccaggcccgcactccacagaaaaaaagattcacccggcgtgggggtgggggcttccagagatggcaaccctctggcaggaatccctcaggatcctgtcagagcctggtctctgggagttgacggagggagggagggagagagagagagagaaagagagagagattatcccagaatgtgcaggggaggaagcataagcaagggctcaggctcagagagacctgagcccaggcacatgcttgctgtgtgacctcggataaaacacttaacttctctg

SEQ ID NO: 1042 - DNA, 321 bp, Homo sapiens
aatcttaactgtttattgatttggagattgtatctcattggtaaagaacagttacttccttcacagtctaaagacaaattgtgtattattctgtgttaaatagcatggcactgttgatcaggagtttacttctgtctcattacaatgtgaacttgttgcccataaaataattctcttaagattgatacatcctgactatgtactaacatgtcatgtcagtttattattttaaatagaatgtgctaataacatatcattttaaggtttatgtgaactatttctctgaaagaataaaaatttgtcactgtataattgaacata

SEQ ID NO: 1043 - DNA, 289 bp, Homo sapiens
tcttaaccacctcatcagactaacctctaacttttgctggctaagaaactgacactatattgaacattacacaacactggtctattcagatataattatgattcccttaacaatatttatttatctcattttgcctctactaaagccttcatacaggcagttatttttgttttgacaattgccttaagatgcatatgttttcatttgcccaaattttgtttaagtttttgttatgaacatacacccacggcaatggcaagagttgcattaaaagagggggaggagggat

SEQ ID NO: 1044 - DNA, 311 bp, Homo sapiens
atgctgccatttactggtttgtgaccctgagtaacttgtttaacttctctgtgcctgttttttaaaatagagataacagtagtaccaactatgtagttccaccatgatggtggaagtgttaaaactaacccaccagcctggagctcagtccctccttccatgggcgagccctcactaactcctaccatctgaggcccaaaaagcactttcccccttgaatggttggaggcctgagcagaagctccagacaggcactggcaggaagcactcactagctctgggccagtgggaagcaccttcctcaggagggt

SEQ ID NO: 1045 - DNA, 2175 bp, Homo sapiens
cctccaggatactccaagcgggcctggacgtggagcgtctctccctcaggaatttcttccatcatttccattccaagcgaggcatgtggagccgtcgccagatgaagacgctgtagccggagggtgtccgcggggcccagcactccccgctctggactagcagtggctccccagggccctgctactgttcagggatggggagtggggtgacggctggaccccaagaggcctcgaagctgacggcccactccacctggagctgtcccctcacagaggcaggttccggggctcctgtctctgcctcctgggccttcagaagggaggactttgagagagaggccaggagggaccacttgctcagtcgagaacgggaagagctcctgagaaggacgggtcaggaaggagagatctgactgagcgacaccatcctcatccatgaaggtgcacgcccacatcccccaagcgctcctcacaccaagcgctgaccaccagaccctcttctagtggacatattttattggggggcggggattttaaaaacagaaaaccgaaactgctgtccagagcgggggtgaggttgtgcactgagggactgtccccacgtgcaggcctcccgcccactcctatgtcccttgggcgttgtccctggccgcgggactggtcccacgtggggcagatctctgctccaccccaggctcgtgccttccagagacacacatctcccagtagccaccaaacagctggccactgattagggcattaacttcctccggatggctcacgtcagaccagaagcacagaacgggctgtttctggtgcttgggcattgggaggtggggagctggcgggcagggggcttgccactccctggcactggacattgaggcctgcagaacaggcagggtgatgaaggcaggggagagaagccctttcccttaccggcgtgcctgtgggtaaggcctcccgagaggacatggagaagaggtaaagaggatgtggacatatctgtcaatttccttaggcaagaagcgggtgggggctggacagaaagggacgaaaagggaagtggaagctgtgagcctcacagtccagctccactgcagacctgcccttctgcagggagagccctggccacccggccttgagtggaagaagaggaaagggtgtacgggggcaaaaccctggacagggagcaggataagaagggggcgggatgagaggtttggggaggtgaggacattgccctgagatatcccctggaggcagggagaggagtgggggcaggaggaactgaagaggggggcagtttcagggaaaatagcccttagcctttttagtcgatgccaccctttctgtcacctggagaccttgtacttctcttgcactaataaccccggtgcttttgtggctgggggtttttctgttgctgctgctgcctccaccactgctgtgaattcacccatggtgcattggacactggatcttgaactccagagtctgtttagggaggtgagcacagggctgggggaggtgcggcggggcccagaagaccaggccactgagcccgcgctccaggctgtgacggtccaaaccacggcactggagctgcagggtctgcctagtgggctctgcattccccgagagcacgagtttggcacatgggagaatggagcccgtggagaaccttctggggggtcggggagaatccctgcctccctttaaggaatcatgaaggacagagacttttgagattgtggcttaggaaggccatacctgctccctgggctgtggctttttctggtccctgctgaggccgactggcccctggagaaggatggtggggcataggctagggctgcagttggccagtggggctgccagtttctttctgggaccactctcgtcctcgggcattgcactggaaggctggaaccagcccaaactgcccacctgcttcacttccaatgactaggagccagcccagcctcctgccctgcccacacccctgcgccctgggccagtgccttgcgtttgatgttacctccacaccatctgccttaagaggaagggccgggcaaggcccctactccctagagaaatgtcttgggtaggagagggtgtgggatggtgggaggggaagcattaaatacagcaacttcttagaaaaaaaaaaag

SEQ ID NO: 1046 - DNA, 771 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccggaagtgacctctagagcggtggtgaaactggcagttgacggctcctgggactagatcccgcgaggtagcccccgaactatttctctacgttttctcttgatcctcccgaaatcttccagatccgcgtagtgaggaatcgtctccaccgtcatggggggcggagacctgaatctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcagcgctatgcggaggatgttggggccgtcaagaaaaaagaagaaaagttggactggatgtaccagggtcctggtgggatggtgaaccgtgacgagtacctgctggggcgccccattgacaaatatgtttttgagaagatggaggagaaggaggcaggctgctcttctgaaacaggacttctcccaggctctatctttgccccatcaggtgccaattcccttcttgacatggccagcaagatccgggaggacccactcttcatcatcaggaagaaggaggaggagaaaaaacgagaggtattaaataatccagtgaaaatgaagaaaatcaaagaattgaggcaaagaatttggaaaaaaggagaaaagaaaagtttatacaccaataaaaaaaactcaggggggggccggaacccaattcgccctaaaggaaacgattacaaattaagg

SEQ ID NO: 1047 - DNA, 2676 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccggaagtgacctctagagcggtggtgaaactggcagttgacggctcctgggactagatcccgcgaggtagcccccgaactatttctctacgttttctcttgatcctcccgaaatcttccagatccgcgtagtgaggaatcgtctccaccgtcatggggggcggagacctgaatctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcagcgctatgcggaggatgttggggccgtcaagaaaaaagaagaaaagttggactggatgtaccagggtcctggtgggatggtgaaccgtgacgagtacctgctggggcgccccattgacaaatatgtttttgagaagatggaggagaaggaggcaggctgctcttctgaaacaggacttctcccaggctctatctttgccccatcaggtgccaattcccttcttgacatggccagcaagatccgggaggacccactcttcatcatcaggaagaaggaggaggagaaaaaacgagaggtattaaataatccagtgaaaatgaagaaaatcaaagaattgttgcaaatgagtctggaaaaaaaggagaagaagaaaaagaaggagaagaaaaagaagcacaagaaacataagcacagaagctcgagtagtgatcgttccagcagcgaggatgagcacagtgcagggagatcacagaagaagatggcaaattcctcccctgttttgtccaaagtccctggatatggcttacaggtccggaactctgaccgtaaccagggtcttcagggtcctctgacagcagagcaaaagagagggcatgggatgaagaaccattccagatccagaagctcctcccactcacccccaagacatgccagcaagaagagcaccagggaagcagggtcccgggacaggaggtctcgatccctgggcagaaggtcacggtccccaagacccagcaaactgcacaactctaaggtgaacaggagagagacaggccaaactaggagcccatcacctaaaaaagaggtctaccaaaggcgacatgctcccggatacaccagaaaactctctgcagaggaattagagcgaaaacggcaagagatgatggaaaacgccaaatggagggaggaggagagactgaacatcctcaagaggcatgctaaggatgaggaacgggagcagaggctagagaagctggactcccgggatgggaagttcatccaccgcatgaagctggagagtgcatctacttcctccctggaggatcgggtgaagcggaatatctactctttacagagaacttcggtagctctggagaagaactttatgaaaagatgaaaactgtcccctctcttattggttttcctgcattttccagggaagctgctgaccccttaattctctttataagagttcaaatgacttctttcacagatgtcaaaccaccagtgttcaaagtgaccctgcttcattgagtcctgaaacagctcacttcctttgagagctagtgtgacttgctttgtgggacactcagtaactttgggttttgactctttaacgggtgggcactggaccatctcggtgggagtgcttgtgccactctggaaggctgttccctggggttgtgatgtttatcatgccacttccttcttacctgtgccaacagacctatttcactgcctcagcgtacaccagacccttcagaaacctctctggtgtcacccagatagattgtgcttactgagacaaatgaacgtttacttgatttagaagataatgtgacagaatgatgtcaggttaggtcaaagccaagggagtgacagaatctggaaaatcaaacaatacaaaaagccctaaatgaactgttaactatttgatctttggatgtaaaattgtaatgcgtatatgtacaaatgtacaatttttacatgcttttaaaaaaggttagctttgtgaaaataccttgtttggtcaatgactttactgggtaatagaaccacattgaaccttgatggcaagtaatacaataaggcaggccagctcgtttttctctctgaatctggctggtttaggaggagcctgggtttatcgacgagatctggagtatctattcttttccactgcttgcagtctccaatgtaggcagtgtaaaggtatagtaaaatgattttaggagtcagaaccaaattgccaatatgctccatggctcctaaaggaaaataaaatggaagtttttaaaaaaaaaaaaaaaaagaaaaaaaaaaaaaaaaaccaacacaaacaagaaacaagaaagacaacaaggacacaaacagagaagaagagaagagaagaagagaatcacagatacaaacagaaagaaaagaaaaagaagagagaggagaggggggggggagtgcggcggcccggaggacgagagagagaaagagtacagcaccatcgggcccgggaggagcgcgacgccgagcgaggtgcaagagaccagaggcgcgcgaggacgcgcgagatgacacatgcggcgggacaagaggaggagagcggcggccaagcagaggcgggcggtggcgcacagga

SEQ ID NO: 1048 - DNA, 2317 bp, Homo sapiens
agccttttaccatttgaaatgcatgtgttgtgcgcgttggggatgggaggagggacctgaatctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcagcgctatgcggaggatgttggggccgtcaagaaaaaagaagaaaagttggactggatgtaccagggtcctggtgggatggtgaaccgtgacgagtacctgctggggcgccccattgacaaatatgtttttgagaagatggaggagaaggaggcaggctgctcttctgaaacaggacttctcccaggctctatctttgccccatcaggtgccaattcccttcttgacatggccagcaagatccgggaggacccactcttcatcatcaggaagaaggaggaggagaaaaaacgagaggtattaaataatccagtgaaaatgaagaaaatcaaagaattgttgcaaatgagtctggaaaaaaaggagaagaagaaaaagaaggagaagaaaaagaagcacaagaaacataagcacagaagctcgagtagtgatcgttccagcagcgaggatgagcacagtgcagggagatcacagaagaagatggcaaattcctcccctgttttgtccaaagtccctggatatggcttacaggtccggaactctgaccgtaaccagggtcttcagggtcctctgacagcagagcaaaagagagggcatgggatgaagaaccattccagatccagaagctcctcccactcacccccaagacatgccagcaagaagagcaccagggaagcagggtcccgggacaggaggtctcgatccctgggcagaaggtcacggtccccaagacccagcaaactgcacaactctaaggtgaacaggagagagacaggccaaactaggagcccatcacctaaaaaagaggtctaccaaaggcgacatgctcccggatacaccagaaaactctctgcagaggaattagagcgaaaacggcaagagatgatggaaaacgccaaatggagggaggaggagagactgaacatcctcaagaggcatgctaaggatgaggaacgggagcagaggctagagaagctggactcccgggatgggaagttcatccaccgcatgaagctggagagtgcatctacttcctccctggaggatcgggtgaagcggaatatctactctttacagagaacttcggtagctctggagaagaactttatgaaaagatgaaaactgtcccctctcttattggttttcctgcattttccagggaagctgctgaccccttaattctctttataagagttcaaatgacttctttcacagatgtcaaaccaccagtgttcaaagtgaccctgcttcattgagtcctgaaacagctcacttcctttgagagctagtgtgacttgctttgtgggacactcagtaactttgggttttgactctttaacgggtgggcactggaccatctcggtgggagtgcttgtgccactctggaaggctgttccctggggttgtgatgtttatcatgccacttccttcttacctgtgccaacagacctatttcactgcctcagcgtacaccagacccttcagaaacctctctggtgtcacccagatagattgtgcttactgagacaaatgaacgtttacttgatttagaagataatgtgacagaatgatgtcaggttaggtcaaagccaagggagtgacagaatctggaaaatcaaacaatacaaaaagccctaaatgaactgttaactatttgatctttggatgtaaaattgtaatgcgtatatgtacaaatgtacaatttttacatgcttttaaaaaaggttagctttgtgaaaataccttgtttggtcaatgactttactgggtaatagaaccacattgaaccttgatggcaagtaatacaataaggcaggccagctcgtttttctctctgaatctggctggtttaggaggagcctgggtttatcgacgagatctggagtatctattcttttccactgcttgcagtctccaatgtaggcagtgtaaaggtatagtaaaatgattttaggagtcagaaccaaattgccaatatgctccatggctcctaaaggaaaataaaatggaagtttttattttgcggcttcacttcttaccgtgtagtaaccttactacaattacagattttcaggagttgtttgctagtctctttcagtcaggtactaaaaaaaaaa

SEQ ID NO: 1049 - DNA, 1643 bp, Homo sapiens
tgtgctgatgcatttttcggcatagacagtccaaatagagaaacgtactgccaggtaactgctgggaggcggaaaggtcacattggaggcaagaagcatagttcagcataagatatttaaattggacctatatatattttctttttcaatgagtgtgtgtattttgatctcttagatcacagaagaagatggcaaattcctcccctgttttgtccaaagtccctggatatggcttacaggtccggaactctgaccgtaaccagggtcttcagggtcctctgacagcagagcaaagagacaggccaaactaggagcccatcacctaaaaaagaggtctaccaaaggcgacatgctcccggatacaccagaaaactctctgcagaggaattagagcgaaaacggcaagagatgatggaaaacgccaaatggagggaggaggagagactgaacatcctcaagaggcatgctaaggatgaggaacgggagcagaggctagagaagctggactcccgggatgggaagttcatccaccgcatgaagctggagagtgcatctacttcctccctggaggatcgggtgaagcggaatatctactctttacagagaacttcggtagctctggagaagaactttatgaaaagatgaaaactgtcccctctcttattggttttcctgcattttccagggaagctgctgaccccttaattctctttataagagttcaaatgacttctttcacagatgtcaaaccaccagtgttcaaagtgaccctgcttcattgagtcctgaaacagctcacttcctttgagagctagtgtgacttgctttgtgggacactcagtaactttgggttttgactctttaacgggtgggcactggaccatctcggtgggagtgcttgtgccactctggaaggctgttccctggggttgtgatgtttatcatgccacttccttcttacctgtgccaacagacctatttcactgcctcagcgtacaccagacccttcagaaacctctctggtgtcacccagatagattgtgcttactgagacaaatgaacgtttacttgatttagaagataatgtgacagaatgatgtcaggttaggtcaaagccaagggagtgacagaatctggaaaatcaaacaatacaaaaagccctaaatgaactgttaactatttgatctttggatgtaaaattgtaatgcgtatatgtacaaatgtacaatttttacatgcttttaaaaaaggttagctttgtgaaaataccttgtttggtcaatgactttactgggtaatagaaccacattgaaccttgatggcaagtaatacaataaggcaggccagctcgtttttctctctgaatctggctggtttaggaggagcctgggtttatcgacgagatctggagtatctattcttttccactgcttgcagtctccaatgtaggcagtgtaaaggtatagtaaaatgattttaggagtcagaaccaaattgccaatatgctccatggctcctaaaggaaaataaaatggaagtttttattttgcggcttcacttcttaccgtgtagtaaccttactacaattacagattttcaggagttgtttgctagtctctttcagtcaggtactaaaaaaaaaa

SEQ ID NO: 1050 - DNA, 1071 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccggaagtgacctctagagcggtggtgaaactggcagttgacggctcctgggactagatcccgcgaggtagcccccgaactatttctctacgttttctcttgatcctcccgaaatcttccagatccgcgtagtgaggaatcgtctccaccgtcatggggggcggagacctgaatctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcatgcttgtgccactctggaaggctgttccctggggttgtgatgtttatcatgccacttccttcttacctgtgccaacagacctatttcactgcctcagcgtacaccagacccttcagaaacctctctggtgtcacccagatagattgtgcttactgagacaaatgaacgtttacttgatttagaagataatgtgacagaatgatgtcaggttaggtcaaagccaagggagtgacagaatctggaaaatcaaacaatacaaaaagccctaaatgaactgttaactatttgatctttggatgtaaaattgtaatgcgtatatgtacaaatgtacaatttttacatgcttttaaaaaaggttagctttgtgaaaataccttgtttggtcaatgactttactgggtaatagaaccacattgaaccttgatggcaagtaatacaataaggcaggccagctcgtttttctctctgaatctggctggtttaggaggagcctgggtttatcgacgagatctggagtatctattcttttccactgcttgcagtctccaatgtaggcagtgtaaaggtatagtaaaatgattttaggagtcagaaccaaattgccaatatgctccatggctcctaaaggaaaataaaatggaagtttttattttgcggcttcacttcttaccgtgtagtaaccttactacaattacagattttcaggagttgtttgctagtctctttcagtcaggtactaaaaaaaaaa

SEQ ID NO: 1051 - DNA, 2438 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccggaagtgacctctagagcggtggtgaaactggcagttgacggctcctgggactagatcccgcgaggtagcccccgaactatttctctacgttttctcttgatcctcccgaaatcttccagatccgcgtagtgaggaatcgtctccaccgtcatggggggcggagacctgaatctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcagcgctatgcggaggatgttggggccgtcaagaaaaaagaagaaaagttggactggatgtaccagggtcctggtgggatggtgaaccgtgacgagtacctgctggggcgccccattgacaaatatgtttttgagaagatggaggagaaggaggcaggctgctcttctgaaacaggacttctcccaggctctatctttgccccatcaggtgccaattcccttcttgacatggccagcaagatccgggaggacccactcttcatcatcaggaagaaggaggaggagaaaaaacgagaggtattaaataatccagtgaaaatgaagaaaatcaaagaattgttgcaaatgagtctggaaaaaaaggagaagaagaaaaagaaggagaagaaaaagaagcacaagaaacataagcacagaagctcgagtagtgatcgttccagcagcgaggatgagcacagtgcagggagatcacagaagaagatggcaaattcctcccctgttttgtccaaagtccctggatatggcttacaggtccggaactctgaccgtaaccagggtcttcagggtcctctgacagcagagcaaaagagagggcatgggatgaagaaccattccagatccagaagctcctcccactcacccccaagacatgccagcaagaagagcaccagggaagcagggtcccgggacaggaggtctcgatccctgggcagaaggtcacggtccccaagacccagcaaactgcacaactctaaggtgaacaggagagagacaggccaaactaggagcccatcacctaaaaaagaggtctaccaaaggcgacatgctcccggatacaccagaaaactctctgcagaggaattagagcgaaaacggcaagagatgatggaaaacgccaaatggagggaggaggagagactgaacatcctcaagaggcatgctaaggatgaggaacgggagcagaggctagagaagctggactcccgggatgggaagttcatccaccgcatgaagctggagagtgcatctacttcctccctggaggatcgggtgaagcggaatatctactctttacagagaacttcggtagctctggagaagaactttatgaaaagatgaaaactgtcccctctcttattggttttcctgcattttccagggaagctgctgaccccttaattctctttataagagttcaaatgacttctttcacagatgtcaaaccaccagtgttcaaagtgaccctgcttcattgagtcctgaaacagctcacttcctttgagagctagtgtgacttgctttgtgggacactcagtaactttgggttttgactctttaacgggtgggcactggaccatctcggtgggagtgcttgtgccactctggaaggctgttccctggggttgtgatgtttatcatgccacttccttcttacctgtgccaacagacctatttcactgcctcagcgtacaccagacccttcagaaacctctctggtgtcacccagatagattgtgcttactgagacaaatgaacgtttacttgatttagaagataatgtgacagaatgatgtcaggttaggtcaaagccaagggagtgacagaatctggaaaatcaaacaatacaaaaagccctaaatgaactgttaactatttgatctttggatgtaaaattgtaatgcgtatatgtacaaatgtacaatttttacatgcttttaaaaaaggttagctttgtgaaaataccttgtttggtcaatgactttactgggtaatagaaccacattgaaccttgatggcaagtaatacaataaggcaggccagctcgtttttctctctgaatctggctggtttaggaggagcctgggtttatcgacgagatctggagtatctattcttttccactgcttgcagtctccaatgtaggcagtgtaaaggtatagtaaaatgattttaggagtcagaaccaaattgccaatatgctccatggctcctaaaggaaaataaaatggaagtttttattttgcggcttcacttcttaccgtgtagtaaccttactacaattacagattttcaggagttgtttgctagtctctttcagtcaggtactaaaaaaaaaa

SEQ ID NO: 1052 - DNA, 2387 bp, Homo sapiens
  misc_feature (2)..(2): n is a, c, g, or t
  misc_feature (4)..(4): n is a, c, g, or t
  misc_feature (6)..(8): n is a, c, g, or t
gncncnnngccggaagtgacctctagagcggtggtgaaactggcagttgacggctcctgggactagatcccgcgaggtagcccccgaactatttctctacgttttctcttgatcctcccgaaatcttccagatccgcgtagtgaggaatcgtctccaccgtcatggggggcggagacctgaatctgaagaagagctggcacccgcagaccctcaggaatgtggagaaagtgtggaaggccgagcagaagcatgaggctgagcggaagaagattgaggagcttcagcgggagctgcgagaagagagagcccgggaagagatgcagcgctatgcggaggatgttggggccgtcaagaaaaaagaagaaaagttggactggatgtaccagggtcctggtgggatggtgaaccgtgacgagtacctgctggggcgccccattgacaaatatgtttttgagaagatggaggagaaggaggcaggctgctcttctgaaacaggacttctcccaggctctatctttgccccatcaggtgccaattcccttcttgacatggccagcaagatccgggaggacccactcttcatcatcaggaagaaggaggaggagaaaaaacgagaggtattaaataatccagtgaaaatgaagaaaatcaaagaattgttgcaaatgagtctggaaaaaaaggagaagaagaaaaagaaggagaagaaaaagaagcacaagaaacataagcacagaagctcgagtagtgatcgttccagcagcgaggatgagcacagtgcagggagatcacagaagaagatggcaaattcctcccctgttttgtccaaagtccctggatatggcttacaggtccggaactctgaccgtaaccagggtcttcagggtcctctgacagcagagcaatcacccccaagacatgccagcaagaagagcaccagggaagcagggtcccgggacaggaggtctcgatccctgggcagaaggtcacggtccccaagacccagcaaactgcacaactctaaggtgaacaggagagagacaggccaaactaggagcccatcacctaaaaaagaggtctaccaaaggcgacatgctcccggatacaccagaaaactctctgcagaggaattagagcgaaaacggcaagagatgatggaaaacgccaaatggagggaggaggagagactgaacatcctcaagaggcatgctaaggatgaggaacgggagcagaggctagagaagctggactcccgggatgggaagttcatccaccgcatgaagctggagagtgcatctacttcctccctggaggatcgggtgaagcggaatatctactctttacagagaacttcggtagctctggagaagaactttatgaaaagatgaaaactgtcccctctcttattggttttcctgcattttccagggaagctgctgaccccttaattctctttataagagttcaaatgacttctttcacagatgtcaaaccaccagtgttcaaagtgaccctgcttcattgagtcctgaaacagctcacttcctttgagagctagtgtgacttgctttgtgggacactcagtaactttgggttttgactctttaacgggtgggcactggaccatctcggtgggagtgcttgtgccactctggaaggctgttccctggggttgtgatgtttatcatgccacttccttcttacctgtgccaacagacctatttcactgcctcagcgtacaccagacccttcagaaacctctctggtgtcacccagatagattgtgcttactgagacaaatgaacgtttacttgatttagaagataatgtgacagaatgatgtcaggttaggtcaaagccaagggagtgacagaatctggaaaatcaaacaatacaaaaagccctaaatgaactgttaactatttgatctttggatgtaaaattgtaatgcgtatatgtacaaatgtacaatttttacatgcttttaaaaaaggttagctttgtgaaaataccttgtttggtcaatgactttactgggtaatagaaccacattgaaccttgatggcaagtaatacaataaggcaggccagctcgtttttctctctgaatctggctggtttaggaggagcctgggtttatcgacgagatctggagtatctattcttttccactgcttgcagtctccaatgtaggcagtgtaaaggtatagtaaaatgattttaggagtcagaaccaaattgccaatatgctccatggctcctaaaggaaaataaaatggaagtttttattttgcggcttcacttcttaccgtgtagtaaccttactacaattacagattttcaggagttgtttgctagtctctttcagtcaggtactaaaaaaaaaa

SEQ ID NO: 1053 - DNA, 1304 bp, Homo sapiens
tgaatttagatctttacattttatttatattctaatggagtgccttagttatctgggctgcataacaaaatatcgtagactcagtggcttataaacaactgaggtttatttctcacagttttggaggctgaaagtccaaggtcaaggtgccagcatgcttgggttctggtgaaggccctcttttgcactgtagactgctgacttcttgctgtaacctcatgtggttgaaagagctagctggctctttggcttcttcttataaaggcagtaattccactcatgaaggctccaccctcatgacctaatttcctcctaaaggccctaccttcaaataccatcaccttgggattcgtgtttcaacataggaattgttacgggaacacaaacattcagcccataacagattttatcaaagaagtacttcatgaaatgtaagtgatgagtggtttttccaaatttgtcatctccattgcatcttcctattaagaaatccactaataataatgttgatgataataaaaacagtaatatccaatattaatccaaagcagtttgggccagatagttgttgctgtattatacatgttggaaacaaccacacttttaggtgtgtttcattttacagctgaggtaccaagaagcaaatattttgtctaatatcacacagatagtagagtagtggaaaggcaatgatgataagtatatgctgttgctagaacacttttccacaactgttacattaacagctttattttctagtgtgaattttcctaaatttaatgagaactaagaggtatttaagactcatacatttattaagttaatatgtgtaaaaaaacatcaacacattgacagaacttctggccataaatattttgatattctataaatagagcatgacatggaaaccttttcttatattaaattacattatgagttttctgatgttgataaagatgtgaatattgtctaaaggcctttctacataccttacactcatagggtttctcaccagtgtgaattctctgatgttcagtaaggtgtgaattaagtctaaaggccttcccacattgtttacactcatagggtttctcaccagtatgaattctttgatgtattctaaggtctacactacgactaaaggccttcccacattctttacatttgtatggttttacacccgtatgaattttctgatgttcagtgaactgcccacgccgactaaaggacttcccacattctttacagtcatagggttttaaaccagaatgaattttcagatgttctttaagattccctctacg

SEQ ID NO: 1054 - DNA, 4992 bp, Homo sapiens
tggggctgggagccgggcgccactgtggccgctgcttttctgagggaaaagagcgcggagtgggccaggttttgcaggccgggccaaggtggagaaaaggttcctgtggagcctcaggccggtgtgctttttttcccgggactgagcttctgcagccctgaggcctggaggcccgggcggtagtaactgtgccggaccaggttcgtgggtgcggcctgtggtgcagttggagaccgaggccccgcgcatcctcgtccgcgcttcagccacttaggcttggccgtagcgaaaaggcccaagagggaagtcagaggtggcggttagttggggccagggaagcgtggagggtgggttccaatcgagtcaagaaaagcctggggtgtcctgaactctgcctgcttccccagccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctcgtgatttggtgatgttcagagatgtggctgtagacttttctcaggaagaatgggaatgcctgaactcatatcagaggaatttgtacagagatgtgatattagagaactatagcaacttggtgtcactggcaggatgttctatttctaagccagatgtgatcaccctattggaacaagggaaagagccctggatggttgtgagggatgagaaaagaagatggactctagatttggaatccagatatgacactaaaaagttatttcaaggaaaggatatttatgaaatgaacttatctcagtggaaggtaatggaaagaattaaaagctgtggacttgaagaacaagaaagtcctcatgaggtgtgtttcaggcaagtgacaaaaaccacctctgaaaaaatgcctacttacagaaaactcacatctcttcctctgtatcagaaaagtcataacagagagaaaccctacgaatgtggggaatgtgggaaggcttttagagtacgacaacaacttactttccatcaaagaattcatactggtgagaaaccctatgaatgtaaagaatgtggaaaagcctttagacagtgtgcccacctcagtcgacatcagagaattcatacttctgacaaactctatgaatgtaaaaaatgtggaaagatcttcacatgtggctcagaccttcgagtacatcagagaattcatattggtgagaagccgtatgaatgtaaagaatgtgggaaagcctttagagttagaggacaacttaatctccatcaaaggattcacacgggtgagaaaccctatgaatgtaaagaatgtgggaaggcctttaggcagtatgcacaccttactcgacatcagagactgaacattgctgagaagtgctatgagtgtaaggaatgtggtcaggcctttctgtgtagtacaggccttcgactacatcacaaacttcatactggagaaaaaccctatgaatgtaaggagtgtggaaaggcctttagagtgcggcagcaacttactctccatcagagaattcacactggtgagaagccttatgattgtaaggaatgtgggaagactttcagtcgtggctatcatctaactctccatcagagaatacatactggtgaaaagccctatgaatgtaaggaatgtcagaagttctttcgtcgttactcagaacttatttcacatcagggtattcacattggagagaaaccttatgaatgtaaggaatgtgggaaggcatttaggctgttctcacagcttactcaacatcagagtattcattttggtgagaaaccctttaagtgtaaggaatgtgagaagacttttagactgctttcacaacttacccaacatcaaagtattcatactggtgaaaagccctatgactgtaaggaatgtggaaaggcctttagacttcattcatcactgattcaacatcagagaattcattctggtgagaaaccatacaaatgtaaggaatgtaaaaaggcatttagacaacattcacatcttacttaccatcagcgaattcataatgtaacttaataattattagaactcttcctttgcgaattttatgttgagcataggaagtacattctagaggaaaggtttttgaacgtgggaatcccttttgcttcatgctcacaactaagcataggaagttttatttaaaggaaagaatatgttaatgaacatatagaagcctttcatcacctttgaaaccatgttaaactttaggaaattcatcctagaaaagaactttattacaggactgaatgtggaaaagcttttgatcttacctattattatctccatattcttccatctgtgtatatacacacgaaggttgctagggaaccacttcattctgaaaatgtgtaaatgaaaggaaagtcatttagtctgcatttcctgtaggaactgtatttcagggcaaccagaagttaaggaggtaaagttcttctttattagaaaattccaggctaatgaatgcagaaagaataatagaaaattatattagaaaaactattgtgtaacacataatgaaataatggatctaggcatgattctctgtacaggttgacaccattcagtgaaggttgtgaactttatagtgaatagatgagactgacaacgtctgaacccactcatcatctcaacttcacaaaaagcaagagagtaaaaattacgtgcctcctaatgtgctacagtaagatatacacatcttgccaaaaatattgaacctgaatttaagcctcaagagccaactcccagtttagagaaaattcaaggaatggaagagtaaattacatgacacaaaaaggagcaattaaatctaaaataagggtaattctacaagaggaatcacctggtttcccaaccaataaaatggcattttaagaaataaggtggaactcctaggtattgacagacttgagacatcagtcaaatgcaatgaaacagtggtttttacttagatcatgagttgaacaaacatgtaaaagaagagatacttaacaataattgggagaatggaatattgacaatattagataatattaagaaactttgttatgtgtgataatagcattgtggttatgtaaaagtgtatttgttagagataatttctgaagtctatacacaggagatgatatatctggaatgtccttttgttcatacaaaagaaaaatgaggatgaataacaagtttggcaaaatgatggtaacctaagtcttggatacatggtttttatttgttttgtttttgctattctacttttgtgtatttaaaattttccatgatgttcttttaaagatcaaattatccatgaaattatagccagtttaaaatgaattattttaaaaaaaatttctggctgggcccggtggctcgtgcctgtagtcccagcactttgggaggccggtgggcagatcatgaggtcaggagtttgagaccagcctgaccatcatggtgaaacctcatctccgctaaaaatgcaaaaattagccaggcgtggtcacatgcgcctgtaatcccagctactcgggcagctgagacaggagaatcacttgggcccgggaggcagaggttgcagtgagccgagatcacgccattgcactccagcctgggcaacaagagcaaaactctatctcaaagaaaaaaagaaaatttctacatattaaaacttgtggatgttgccaaagctctacacattgggattggaatattaattacactataatgacgataatgtattcaggaagttaaaatgtaggtccacattttatttagttgacctctctatctctatattatagtacccatggtatgcacctttttttttttttttttttgagacggagtctcgctctttcgcccaggctggcgtgcagtggcacagtctcggctcactgcaagctctgcctcccgggttcaagccattctcctccctcagacttccgagtggctgggattacaggcgcccgccaccacaccaggttgatttttgtatttttagtggagatggggtttcaccatgttggccaggctggtctcaactcctgacctcaggtgatccacctgcctcggcctcccaaggtgctgggattgcaggcgtgagccaccatgcccggctctcacttcatatgtttaaagaatgagtaaaagaaagcaattactactgctaaatgtgggaaataatggactagacctgtactaatatatggtagtcactagcaacctgttgagcacttgaaattgagttattgagcactgaaatgtggctagtccaaattcaaatggtgtttttttgtaaaacacaagattctgaagacttagttattttaaaaaagttaagtatctcaatttttcatattgagtacatattgaaataatattttagatatattggttcaaataaaatacattaaaatgaataacacttttttgtttttaaaattgttataggaaaatttatatatgtagctcacgtatttctattgtcagcgctggcataaacaataaaaagtagacttggtttttttgtgtgtgtttctttaaaagataccaatatagtcaagacctttgcagttttgatcacagaaatatgaaagattacacagctacagctatatgaatgataaaagtgacagctatggatttttaaagttataagttgctatactacatatatgtaatgtgtgtgtgtatagtgtgtaggtatatatatttatatttatacacacactatacatgtattttaaaatattgaaaatccagaattattttatggtaaaaattactaaaattgacttcacatgctgaatgaagagagcctgagtagaccaacaaacaaatgaaaaattaagacggttagaagatacgctttctaaaagaatacatttagaatctaacttt

SEQ ID NO: 1055 - DNA, 1779 bp, Homo sapiens
tggggctgggagccgggcgccactgtggccgctgcttttctgagggaaaagagcgcggagtgggccaggttttgcaggccgggccaaggtggagaaaaggttcctgtggagcctcaggccggtgtgctttttttcccgggactgagcttctgcagccctgaggcctggaggcccgggcggtagtaactgtgccggaccaggttcgtgggtgcggcctgtggtgcagttggagaccgaggccccgcgcatcctcgtccgcgcttcagccacttaggcttggccgtagcgaaaaggcccaagagggaagtcagaggtggcggttagttggggccagggaagcgtggagggtgggttccaatcgagtcaagaaaagcctggggtgtcctgaactctgcctgcttccccagccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctcgtgatttggtgatgttcagagatgtggctgtagacttttctcaggaagaatgggaatgcctgaactcatatcagaggaatttgtacagagatgtgatattagagaactatagcaacttggtgtcactggcaggatgttctatttctaagccagatgtgatcaccctattggaacaagggaaagagccctggatggttgtgagggatgagaaaagaagatggactctaggccctaccttcaaataccatcaccttgggattcgtgtttcaacataggaattgttacgggaacacaaacattcagcccataacagattttatcaaagaagtacttcatgaaatgtaagtgatgagtggtttttccaaatttgtcatctccattgcatcttcctattaagaaatccactaataataatgttgatgataataaaaacagtaatatccaatattaatccaaagcagtttgggccagatagttgttgctgtattatacatgttggaaacaaccacacttttaggtgtgtttcattttacagctgaggtaccaagaagcaaatattttgtctaatatcacacagatagtagagtagtggaaaggcaatgatgataagtatatgctgttgctagaacacttttccacaactgttacattaacagctttattttctagtgtgaattttcctaaatttaatgagaactaagaggtatttaagactcatacatttattaagttaatatgtgtaaaaaaacatcaacacattgacagaacttctggccataaatattttgatattctataaatagagcatgacatggaaaccttttcttatattaaattacattatgagttttctgatgttgataaagatgtgaatattgtctaaaggcctttctacataccttacactcatagggtttctcaccagtgtgaattctctgatgttcagtaaggtgtgaattaagtctaaaggccttcccacattgtttacactcatagggtttctcaccagtatgaattctttgatgtattctaaggtctacactacgactaaaggccttcccacattctttacatttgtatggttttacacccgtatgaattttctgatgttcagtgaactgcccacgccgactaaaggacttcccacattctttacagtcatagggttttaaaccagaatgaattttcagatgttctttaagattccctctacg

SEQ ID NO: 1056 - DNA, 884 bp, Homo sapiens
tggggctgggagccgggcgccactgtggccgctgcttttctgagggaaaagagcgcggagtgggccaggttttgcaggccgggccaaggtggagaaaaggttcctgtggagcctcaggccggtgtgctttttttcccgggactgagcttctgcagccctgaggcctggaggcccgggcggtagtaactgtgccggaccaggttcgtgggtgcggcctgtggtgcagttggagaccgaggccccgcgcatcctcgtccgcgcttcagccacttaggcttggccgtagcgaaaaggcccaagagggaagtcagaggtggcggttagttggggccagggaagcgtggagggtgggttccaatcgagtcaagaaaagcctggggtgtcctgaactctgcctgcttccccagccctgccagtttccagagaaggcgcttgagaaggagaaacgaatcgctgctgctcttctaaaagccggttccctctctggtgtctgtggaccctgcttctgaagtacatgaaccttgaggaaaattgaccagttctagcagttctaaaatcatggctcgtgatttggtgatgttcagagatgtggctgtagacttttctcaggaagaatgggaatgcctgaactcatatcagaggaatttgtacagagatgtgatattagagaactatagcaacttggtgtcactgggtaagcctagcatatctgtgtcagataatttagacattcacaggactgaatttctgggctgtctttctttttgtttttttccaaagacgaagtctcgctgagtcaccaggctggagttgcagtaagccgagattgcgccattccactccagcttgggcaacaagagcgaaactctgtctttaaaaaaaaa

SEQ ID NO: 1057 - DNA, 526 bp, Homo sapiens
gggtgaggctggggctgggagccgggcgccactgtggccgctgcttttctgagggaaaagagcgcggagtgggccaggttttgcaggccgggccaaggtggagaaaaggttcctgtggagcctcaggccggtgtgctttttttcccgggactgagcttctgcagccctgaggcctggaggcccgggcggtagtaactgtgccggaccaggttcgtgggtgcggcctgtggtgcagttggagaccgaggccccgcgcatcctcgtccgcgcttcagccacttaggcttggccgtagcgaaaaggcccaagagggaagtcagaggtgaacgccccaggatgaaggtcccctgcaaaacgctgggacctagatttggggtgggtgtctggggtctaggaggacacgctggacagttccgaaaagacacagtgggtggtcccgggcgtgggcaaccgggtgcggaactacagcgtacccggagctgcgaacccagacgcgggtgactgctgaccctctgccctgtcgttt

SEQ ID NO: 1058 - DNA, 3545 bp, Homo sapiens
tggtcaccgatttctattataaagttttcgtttgtttattttgtgtagaacaggaaaatatgttttggtcttgttttctttcagatttggaatccagatatgacactaaaaagttatttcaaggaaaggatatttatgaaatgaacttatctcagtggaaggtaatggaaagaattaaaagctgtggacttgaagaacaagaaagtcctcatgaggtgtgtttcaggcaagtgacaaaaaccacctctgaaaaaatgcctacttacagaaaactcacatctcttcctctgtatcagaaaagtcataacagagagaaaccctacgaatgtggggaatgtgggaaggcttttagagtacgacaacaacttactttccatcaaagaattcatactggtgagaaaccctatgaatgtaaagaatgtggaaaagcctttagacagtgtgcccacctcagtcgacatcagagaattcatacttctgacaaactctatgaatgtaaaaaatgtggaaagatcttcacatgtggctcagaccttcgagtacatcagagaattcatattggtgagaagccgtatgaatgtaaagaatgtgggaaagcctttagagttagaggacaacttaatctccatcaaaggattcacacgggtgagaaaccctatgaatgtaaagaatgtgggaaggcctttaggcagtatgcacaccttactcgacatcagagactgaacattgctgagaagtgctatgagtgtaaggaatgtggtcaggcctttctgtgtagtacaggccttcgactacatcacaaacttcatactggagaaaaaccctatgaatgtaaggagtgtggaaaggcctttagagtgcggcagcaacttactctccatcagagaattcacactggtgagaagccttatgattgtaaggaatgtgggaagactttcagtcgtggctatcatctaactctccatcagagaatacatactggtgaaaagccctatgaatgtaaggaatgtcagaagttctttcgtcgttactcagaacttatttcacatcagggtattcacattggagagaaaccttatgaatgtaaggaatgtgggaaggcatttaggctgttctcacagcttactcaacatcagagtattcattttggtgagaaaccctttaagtgtaaggaatgtgagaagacttttagactgctttcacaacttacccaacatcaaagtattcatactggtgaaaagccctatgactgtaaggaatgtggaaaggcctttagacttcattcatcactgattcaacatcagagaattcattctggtgagaaaccatacaaatgtaaggaatgtaaaaaggcatttagacaacattcacatcttacttaccatcagcgaattcataatgtaacttaataattattagaactcttcctttgcgaattttatgttgagcataggaagtacattctagaggaaaggtttttgaacgtgggaatcccttttgcttcatgctcacaactaagcataggaagttttatttaaaggaaagaatatgttaatgaacatatagaagcctttcatcacctttgaaaccatgttaaactttaggaaattcatcctagaaaagaactttattacaggactgaatgtggaaaagcttttgatcttacctattattatctccatattcttccatctgtgtatatacacacgaaggttgctagggaaccacttcattctgaaaatgtgtaaatgaaaggaaagtcatttagtctgcatttcctgtaggaactgtatttcagggcaaccagaagttaaggaggtaaagttcttctttattagaaaattccaggctaatgaatgcagaaagaataatagaaaattatattagaaaaactattgtgtaacacataatgaaataatggatctaggcatgattctctgtacaggttgacaccattcagtgaaggttgtgaactttatagtgaatagatgagactgacaacgtctgaacccactcatcatctcaacttcacaaaaagcaagagagtaaaaattacgtgcctcctaatgtgctacagtaagatatacacatcttgccaaaaatattgaacctgaatttaagcctcaagagccaactcccagtttagagaaaattcaaggaatggaagagtaaattacatgacacaaaaaggagcaattaaatctaaaataagggtaattctacaagaggaatcacctggtttcccaaccaataaaatggcattttaagaaataaggtggaactcctaggtattgacagacttgagacatcagtcaaatgcaatgaaacagtggtttttacttagatcatgagttgaacaaacatgtaaaagaagagatacttaacaataattgggagaatggaatattgacaatattagataatattaagaaactttgttatgtgtgataatagcattgtggttatgtaaaagtgtatttgttagagataatttctgaagtctatacacaggagatgatatatctggaatgtccttttgttcatacaaaagaaaaatgaggatgaataacaagtttggcaaaatgatggtaacctaagtcttggatacatggtttttatttgttttgtttttgctattctacttttgtgtatttaaaattttccatgatgttcttttaaagatcaaattatccatgaaattatagccagtttaaaatgaattattttaaaaaaaatttctggcgtgagccaccatgcccggctctcacttcatatgtttaaagaatgagtaaaagaaagcaattactactgctaaatgtgggaaataatggactagacctgtactaatatatggtagtcactagcaacctgttgagcacttgaaattgagttattgagcactgaaatgtggctagtccaaattcaaatggtgtttttttgtaaaacacaagattctgaagacttagttattttaaaaaagttaagtatctcaatttttcatattgagtacatattgaaataatattttagatatattggttcaaataaaatacattaaaatgaataacacttttttgtttttaaaattgttataggaaaatttatatatgtagctcacgtatttctattgtcagcgctggcataaacaataaaaagtagacttggtttttttgtgtgtgtttctttaaaagataccaatatagtcaagacctttgcagttttgatcacagaaatatgaaagattacacagctacagctatatgaatgataaaagtgacagctatggatttttaaagttataagttgctatactacatatatgtaatgtgtgtgtgtatagtgtgtaggtatatatatttatatttatacacacactatacatgtattttaaaatattgaaaatccagaattattttatggtaaaaattactaaaattgacttcacatgctgaatgaagagagcctgagtagaccaacaaacaaatgaaaaattaagacggttagaagatacgctttctaaaagaatacatttagaatctaacttt

SEQ ID NO: 1059 - DNA, 3330 bp, Homo sapiens
tggtcaccgatttctattataaagttttcgtttgtttattttgtgtagaacaggaaaatatgttttggtcttgttttctttcagatttggaatccagatatgacactaaaaagttatttcaaggaaaggatatttatgaaatgaacttatctcagtggaaggtaatggaaagaattaaaagctgtggacttgaagaacaagaaagtcctcatgaggtgtgtttcaggcaagtgacaaaaaccacctctgaaaaaatgcctacttacagaaaactcacatctcttcctctgtatcagaaaagtcataacagagagaaaccctacgaatgtggggaatgtgggaaggcttttagagtacgacaacaacttactttccatcaaagaattcatactggtgagaaaccctatgaatgtaaagaatgtggaaaagcctttagacagtgtgcccacctcagtcgacatcagagaattcatacttctgacaaactctatgaatgtaaaaaatgtggaaagatcttcacatgtggctcagaccttcgagtacatcagagaattcatattggtgagaagccgtatgaatgtaaagaatgtgggaaagcctttagagttagaggacaacttaatctccatcaaaggattcacacgggtgagaaaccctatgaatgtaaagaatgtgggaaggcctttaggcagtatgcacaccttactcgacatcagagactgaacattgctgagaagtgctatgagtgtaaggaatgtggtcaggcctttctgtgtagtacaggccttcgactacatcacaaacttcatactggagaaaaaccctatgaatgtaaggagtgtggaaaggcctttagagtgcggcagcaacttactctccatcagagaattcacactggtgagaagccttatgattgtaaggaatgtgggaagactttcagtcgtggctatcatctaactctccatcagagaatacatactggtgaaaagccctatgaatgtaaggaatgtcagaagttctttcgtcgttactcagaacttatttcacatcagggtattcacattggagagaaaccttatgaatgtaaggaatgtgggaaggcatttaggctgttctcacagcttactcaacatcagagtattcattttggtgagaaaccctttaagtgtaaggaatgtgagaagacttttagactgctttcacaacttacccaacatcaaagtattcatactggtgaaaagccctatgactgtaaggaatgtggaaaggcctttagacttcattcatcactgattcaacatcagagaattcattctggtgagaaaccatacaaatgtaaggaatgtaaaaaggcatttagacaacattcacatcttacttaccatcagcgaattcataatgtaacttaataattattagaactcttcctttgcgaattttatgttgagcataggaagtacattctagaggaaaggtttttgaacgtgggaatcccttttgcttcatgctcacaactaagcataggaagttttatttaaaggaaagaatatgttaatgaacatatagaagcctttcatcacctttgaaaccatgttaaactttaggaaattcatcctagaaaagaactttattacaggactgaatgtggaaaagcttttgatcttacctattattatctccatattcttccatctgtgtatatacacacgaaggttgctagggaaccacttcattctgaaaatgtgtaaatgaaaggaaagtcatttagtctgcatttcctgtaggaactgtatttcagggcaaccagaagttaaggaggtaaagttcttctttattagaaaattccaggctaatgaatgcagaaagaataatagaaaattatattagaaaaactattgtgtaacacataatgaaataatggatctaggcatgattctctgtacaggttgacaccattcagtgaaggttgtgaactttatagtgaatagatgagactgacaacgtctgaacccactcatcatctcaacttcacaaaaagcaagagagtaaaaattacgtgcctcctaatgtgctacagtaagatatacacatcttgccaaaaatattgaacctgaatttaagcctcaagagccaactcccagtttagagaaaattcaaggaatggaagagtaaattacatgacacaaaaaggagcaattaaatctaaaataagggtaattctacaagaggaatcacctggtttcccaaccaataaaatggcattttaagaaataaggtggaactcctaggtattgacagacttgagacatcagtcaaatgcaatgaaacagtggtttttacttagatcatgagttgaacaaacatgtaaaagaagagatacttaacaataattgggagaatggaatattgacaatattagataatattaagaaactttgttatgtgtgataatagcattgtggttatgtaaaagtgtatttgttagagataatttctgaagtctatacacaggagatgatatatctggaatgtccttttgttcatacaaaagaaaaatgaggatgaataacaagtttggcaaaatgatggtaacctaagtcttggatacatggtttttatttgttttgtttttgctattctacttttgtgtatttaaaattttccatgatgttcttttaaagatcaaattatccatgaaattatagccagtttaaaatgaattattttaaaaaaaatttctggcgtgagccaccatgcccggctctcacttcatatgtttaaagaatgagtaaaagaaagcaattactactgctaaatgtgggaaataatggactagacctgtactaatatatggtagtcactagcaacctgttgagcacttgaaattgagttattgagcactgaaatgtggctagtccaaattcaaatggtgtttttttgtaaaacacaagattctgaagacttagttattttaaaaaagttaagtatctcaatttttcatattgagtacatattgaaataatattttagatatattggttcaaataaaatacattaaaatgaataacacttttttgtttttaaaattgttataggaaaatttatatatgtagctcacgtatttctattgtcagcgctggcataaacaataaaaagtagactggaaaaaaaaaaaataaaaaaaaatttggggcgctgggccggaaagtttttagaacatttgtggggcggggcggggagggacagggcaaggggtcagagaacggcagatggggggtcacaaaaaagccgggacggggtgaaaccagagtgggtggtctaaggcaggca

SEQ ID NO: 1060 - DNA, 376 bp, Homo sapiens
atttcactttgaagattgcgttctgatttgtagctttaagcgattagagaaaattgtgcaatattcccctctacctgtttgaaaataaacattcttaaaaggatgtaatttagataatgaattgctttctctgaaacttatcccttgggacacctcaaatctgattggttttcaaagcttgggggaaggaaattaattcctgtgataagtggttggctgaacagaatgtcttgaaaggttagcctgtagcattaggagaaatacctaatgtaaacgacgagttaatgggtgcagcacaccagcgtggcacatttatacatatgtgacaaacctgcacgttgtgcacatgtaccctagaacttaaagtataataata

SEQ ID NO: 1061 - DNA, 245 bp, Homo sapiens
tttaatccataaaggcatgcctgtattttgttgaatttatttcttgatacatgttattttaatttctattgtacacattaaaaagttatgtttttgattgttgctggtgtaaacatttgcatttgaattttttgcactgattttttgtccccaaattgtttgtgccatcaccaatataaaacttatttgtagatgtctttggattttcttgaagaaaataaaacagtcatgagtaattataagtt

SEQ ID NO: 1062 - DNA, 586 bp, Homo sapiens
tttaaaaatcccatgtttccctttataattaacaaaatccatgaattaaaatgggtctttgtgctaatctttagggcagcaagaaatgaggctcttgagaaatagtaccccattttgctatcaccttagatgttggagagggaaagagagggcgagagagctgaaagaaatccttcgcaagaaaacaaagtaagtggacagagtagttggcggggaacatctgggattataaacactgggggcaaagacaagaccttgtgaaatgcctgacatagtatctcacgaacctgatgaataaaaccatgatatctgggtgaccctggtgacaacgctgggaaaggtgagaggaaacagagagcgctgtgtttgagagtaatgttattggttctttaggaacgagaccgtgggctcttagtgacgctgtgggttcctgagttgtctgggagtacagggactgcagcctcgagtctgtccagctacgatcactttggaaggccttcggtgggatgcgggcagaaagctcccagtgcaaagggcgtgccacgaaaaccaccagccagaaacctgagctgggacaggtgcgctc

SEQ ID NO: 1063 - DNA, 467 bp, Homo sapiens
gtgagctgagatcgtaccactgcactccagcctgggcgatagagccagactgagtctcaaaaaaaaaaaaaaagttacctttttttggtaaggttgtacttcttagataatggtcattgtcactaccaacttgcctgcattgtaatagagtcctattcactttgctcccaaccccactacggagatgactgatgactagttgtatacacagtgggtgtgccctgagaggtctgttgccagcagtggtgatcgatcacggcctccccctgctggctgatgtgatggtccttggtcctcctctgaaggaggtagaaggggcacacggccaccgtgggaagtaggcagaaaagcctccctgggtgcagattctctgagaaaagaactttggcctcatagttaacttactccaaaagctttcgtgtgaaataatttataattttttatataaataaaaagattaaaatgtg

SEQ ID NO: 1064 - DNA, 296 bp, Homo sapiens
tagtaagtgctatacattcttcatttgtttgtttgaagacagggtatcagcactttgggaggccaaggtgggcagatcacttaaagccaggagactgagaccagcctggccaacatggcaaaaccaactctactaaaaatacaaaaattagctgggcatggtggtgcatgcctgtaatcccagctacttgggtggttgagacacaagaatcatttgaacctggaaggaagaggttgcagtgagctgagatcgtatcactgcactccagcctcagcaagagagcgagactctatctc

SEQ ID NO: 1065 - DNA, 1133 bp, Homo sapiens
aatgggcggcaaagcgccgcaggcacagagcctcctttcatctctgcagcaggctgagtttaaaaagcagattttctacacaatgtcgtacgcgagtctcagcagagctcaggccacgacctccagctgcctgcaagcctgcatcttcctctgggaggcttcccccctcaccctgcatcagggcccgggcttgaggggtgatggaggcaggttcccctgcagccggcggttctgggagcaggtgcccgaggcggaggccatggcctctgagcaggtggcagcttcgcccccaccagagcctgcagccctcacagcatcccacattgccccagcctctgcctgggccaatggctcctggtgtcattaaagactctgtttttacctcctctgggcctcgggagaccagcctggcaccagaggaggggctggcagagccccaggctccagtccacacccaccggccccaggtctggccatgggctgggccctggtgtgcagacagcagtggccactgctccagggcctttgcaccagcctgctgcaggtccaggcggtcatggggagtggagccgcagcggcctcttgttttccttcccctcttgggagacggctgctcctcctggctgtttccagaaagtgtgtttgttatttggctcctggaaacaccatctgatgaaacaggctctgttgggctggcctgccaggcggaggctgtgggcgcccaggagtctcaccacgaagcaggtggcagaggcccgatagccccaccctgcaggccgggacctggcacctaaacggggagatggaagaacatggaaaattccctaagagcaaattgatgctcagcttccgcgggcaccaacttgctgcggaatcctgctttgcagatcatcgttcctcgagcattcggacgcctcgggccccagaagttcaagaacaagaaagctctgtttcatgcagacacgctcacgcatgcacacatgctcacacatgcacttatacgtgcacacacacacacacaacacacacacacgcacactcacacaaccatggccatgtagccccagtctcagcatcatgtcctctatttagaaatattggctaaacacctaataaataactaaacagaaatg

SEQ ID NO: 1066 - DNA, 406 bp, Homo sapiens
atctccactattagggtgaaaaataaggagtcttctagaaaaggccttggggtgtgttatgtaagaaatactaagtcagttcactgtttccaggcttttcttacgaaagttaacagccacagctctttttggagcataaatgctgagcttttcctaaactctgaaacacttggcaacctctcagtcttgctaacagctattttttttttattttgttttcttttccaaatccctggcatactgctgaaatctggctgctgccgcccctggagagacgcccgtctgctgggggagtcaggctggggtacctgccagcgctcacgggctgtgccactccaggcaggctcaacaactacttcaaaacagaaagcggctgtaattcacaattcagcccactacaggcacc

SEQ ID NO: 1067 - DNA, 300 bp, Homo sapiens
cagtgatcaaatctaagagttttcgtggtggaatcataaggttattctagacataagattgtaccatcagcaaacaagaataatctgaccttctcttttccaatttggatgactttttttcttttccttacctgattttctctggctaagacttctagtacaatgttgaataggagtggtgaaaattagcatccttatctcattccagtttctaaagggaatgttttcaacatttctccattcagtgttatattggctgtgggtttgtcatatatggcaattattactttgagacacaat

SEQ ID NO: 1068 - DNA, 573 bp, Homo sapiens
gagccttctgctggaaactgtgcttctggcaggtagatgagagaagagagaaacttagaggatcttagagaatctgggtggcaggtatggtgaggaaatggtgacggtcacaggctatcggccagaaacagatcacatggctgcctctcattgcaagggagcttgggatataccgtctagctgagtgcccaggaggaaaagggacaggaggtagggtgagcagcccgacttccttaggcttcagcagtgaggagactcatccaggccacatgaaaggaggaggcacgcctcacctcccatgctcctcctcgtttgaaaattatgtgtgtcctggaccagtaccccagatgggagggtatagtggacccagatggaaagagaggatcaggagggcaaagccatctcatgccagggccatcctgaccctggctgactggaggagctacaggagccagcctgggaaccccttccagcaccaactgcaagactcatctgccagctaccactcccttgccccatgaaacttactcttgctttttatcagcagaggaaagtgggcatggggacaaaacc

SEQ ID NO: 1069 - DNA, 471 bp, Homo sapiens
cattaatataaaaatacatgtttttcgctttttccatgtactcgtagggtttcaagtatttggaaaaccaagaacatcaataacaaaacccaccctgtagcttgagtgtgaccctaaaagctgcttttaaccaggatgagtgatggaaaattttatccttagccctggttttggggggtgtgttttgttttgttttgaagaaaaccctgagtaaatcaaaagggctacagagatgtgtttgggtaacttaaccacgcttaatgactaggaaggcactcttctaaacagtctgacctgtgtttccactgttgcttatccatttatcaactggagcctttatgcacagccatgtgggttcctctggccttttatctgactcctaagtggaaacagtctccatgcatcttgcttcagttgaagggcatcttgcttcagttgaagggtggctctatggtctgttgccactctggc

SEQ ID NO: 1070 - DNA, 424 bp, Homo sapiens
gccagacttgagaggcagctgctcactctctctcacttgtcacactttcatccatacatttcctttatctctaagttttattttatgcatgaacgagtctaaaaccatcatatatcaattcaggtctgttatttctaagccctagttatgctcaacccttgtctgtggctgtaggtcgattatgaatctggttctgggcaccaaaagggcagagagaccacatgttgacatcccccttacccactctcaacaagaaacatcccaggttgagtataaaaatctttaagccaatctgtagagctgagcacatctgggtttgatgcaggctgaaagttgggcctagggtttctactccatgtgtctcctggttctgggacacaggctgaaggaggtagcaccagtggggacctgtggttctctgatg

SEQ ID NO: 1071 - DNA, 470 bp, Homo sapiens
gtaaaatgaccttttctctccagcatgcttcatatgatgacactaagtggtatgcattcccaaaaaactgatttaggtagatgtgggggacactcagggtggattcatgatgccaaaggataacagacaatggaaagcattttacaactgttcacagtaccagcaagtcaagcacgtcacctaacaaaggggctacatcacaagctcaaaacttccgataactttacattcccctaaggtgagagggtgtatttaaataacatcaatccaaccaaagccttgctccaacttccacatcaactattttccttgggcgaaacagagcattgcattgcattaagtgtatttacaaccaactgtctgtgtaaatataagagatgctaacatactagtaacagaacgaaattagccttgctgattttgccctgccttcccagttgcttagcaactgattcaaagtgaaaattaaa

SEQ ID NO: 1072 - DNA, 830 bp, Homo sapiens
aagcaggggagtgagaggacctaattgatattttcaaaaggttgctgtaattgcttcatatagactggactggagcaacaagagtgtaagcagatagactcattagtagaccattatatagcaactcagtcgagagaggaagttgactttggcttcaggtgggggcagtggggatattcagatatacaagatatatttttgagataaaagccattggactgggtgatggtttggatctggtgagtgaaggagaggaaggtgtgaagagtgattcccaagtctccagcttgagccataatgagaggtggtggaagacaggcggggaagcaggattagacttaacactatgcagacacccgtgaactaggtaagttgaatacacagcctgaaacttagggcaggtgtctgggttagggatgtacctttggaagtgctcaggattagaaagcatttgaaatcttgggaatggaagacatcacccgggagagacccttattttttagagtttggtaaatgagaaaaatgagtagtgtgacgacatagaaataggttacaggtttctcccatcctgtgagaaaccatgtgagttttggactagagttcaatgctgtttcagatttggggaaagcaacaggttaatgtgggaaaatcatgttgaggaagaaagtaatacattttattttcaacgttgtattggagactcttagaaatgattgagaaatgtggtggctcatgcctgtgatccaggctggaggattccctgaggccaggagtttgagaccagcctgggcaacatagcatgatcctgtctttacaaaaagtaaaaaaaa

SEQ ID NO: 1073 - DNA, 382 bp, Homo sapiens
taagatgccctacctgataccagactctctgggttcaaatccaggttgtcttccttaccagctctgtaactcttgggcaagccacttgacctttctatctgtagtttccacaattatcaaatgaagatgatcattatagtgcttacctcacttagccatcaagagcatagtaagtgcttgataatcttgtctgttatctatcttgtctggcccacattcatgcctttgcctgtggcttgagccacttgtatacttccctaatcccagaagaaccaacatagtcatgagccctgaggctgagagctcactcttctgattttcttcagtgtccagaataatggtttgcacagagcaagtgctcatttagtacttgcattgaatt

SEQ ID NO: 1074 - DNA, 313 bp, Homo sapiens
gaaaactttaagatacagaagagaagggatggttgatgaaaccagaaccctgagaaagcagacagggttagaccctcaaaataaatagaggacttgcccattacatgaaggtcacctcttccattaacaagaaggaaggcaggaaggatggatgtgaagaaagttaagcttgccggttaagtgctgacagagagttaaaaaggcatctaatttctctgtgaaatgggaagtgatgtcacttgataagggctaagggagggaaagccagggcaggaggggagaaggaggagtaacgtttttggagcatccatta

SEQ ID NO: 1075 - DNA, 375 bp, Homo sapiens
atgcagattaaacacaaaaagtcccagtccctttggaaagtaacttagcattctggtaattacatttgacctgtgtgctgtaaaaggttttggttttggttttagttttaatgtagatatttaacagagctgaatttctgtgccttttatgtgtgagctgctgcactgcctcctctccttgtcctaacagggactcacacacagcattcccctcacacagaccccagaaaatcccatcggtgtccttactggggccaaacactgagcactggttcctagaacctgaggcatgaaataaaccaattcattgttttctgcataatttcacatgcttttaaaataataagtgataatggatacattaccatgttgcct

SEQ ID NO: 1076 - DNA, 412 bp, Homo sapiens
cttacatatgtcattctttttcaattttaaagaaatttttgggccgggcaccgtggctcacgccttcaatcccagcactttgggaggcagaggcaggtggatcacgaggtcaggagttcaagaccagcctggccaagatggtgaaatcccgtctctactaaaaatgccaaaattagctgggcatggtggtgggcgcctgtaatcccagctactcaggaggctgaggcagagaactgcttgaacccaggaggtggaggtcacagtgaaccgagatcgtgctactgcactccagcctggtcaacagagcaagactccgtctcaaaagaaatttttaatagactatttttagaacagttttaagttcacagcaaaattagtggaaagtatagactttccacgaattatcttccac

SEQ ID NO: 1077 - DNA, 440 bp, Homo sapiens
aaaactagaacctttctttgattcatgtaggatattctgactaagtcagagagatgctggtgaatgctttccaagatttcttttattataaagtgaatggaaaggacatttaataatgctatacctgcctgaaaaaaatgccagctttcattaagtcagtggcaattaaatgcaacacttggcaaataaattgaacaaagcatctggctagcctgtaagtatgaatcatcttcaatggaagtaccaaattatagcaaaaaaaaataaagggatataaaaaggaaaataaaattcagacatgattagggccatgagtaaaaataatccaagttgatatgtggcaacttgtaatgcagcataattttagaaaattatttagtgaatgtataaatgtgacatgcctgaaaaatgttaattaaactggtttacgcaatggtgga

SEQ ID NO: 1078 - DNA, 338 bp, Homo sapiens
gtcgtcagaggccacactccaggcctcagggaccccaccctgagaatcagcatctgtgagcagggagcagtcagtcagaaccacacacaaaaaggaaactctcaagtggcactttcccccggagtgaaccctaagcagaggcaggagaggacaacatgagggatgcggacagagtgcgctttctctggaaaggaggagtttataccactgctgggagctttaaaaaatggaaaccctgcctgtgatatcagcactttgaaaggccgaggcaggagtatcacttgagcccatgagtttaagaccagcctgggcaatatagtgagaccttgtctgtatta

SEQ ID NO: 1079 - DNA, 447 bp, Homo sapiens
gaaaaaatgttcacttgctgagtagcagatcacataatattgaaaagatcatatgtgaaaaacataattttgaaaaattatcttgcacataatacgtaaatattcagtcttccaccacaccatacgtacatttatatttataatgataggcattaatcacagaaacttctattaagaaaaggcactcgcataagcaccttgacttcctgcagtggtccagtgtcttgtccttacactggaggactcacagtttccccagcttctaccttcagggaaactgtatactgcttctggacctttattatttgcacgatcatgcccgtgctgttgtttacgacacatactagcaatgagccattcagcctatttatttattcagggcccaaaatctgaacaataacaacttaaaaaaacttattgtaacccaagcaagatgaagactagaat

SEQ ID NO: 1080 - DNA, 446 bp, Homo sapiens
ttctctgtgttttggatttattttttgtggggatgtaaaattgggatgatgttaacatgtcatatggttgtttcaaagaccaaatgagtgaactgggtttatagtaaattcttataattttgtacttgtacacaattaattttctcttcaatgccattttctttaagtaagttagttgaattcagtcacagtattaccatatattataaatagctaaaattcatgattagacttaggtggatgcaaagaatgtatttgtgtgctttgtgaaacttgtaatggcaactttgagcaaaaggagcaaaatgtataaacaaactcatcttcattatagtaagtgccaaatacatctggaacacatcagcaaattagtgtttaacatatttcagtgaactccagcattttatatctgtatttctacagtcagagggctttctcttgggtac

SEQ ID NO: 1081 - DNA, 341 bp, Homo sapiens
aaggaagtcttaccccggtgcagcctctgccacccagctctttgttcatgcaggtgccctttttccttcttctggggtttgcctgtgtgactttatgccaggccctaccctaggctggctaatcagagtggccggggaggactgggggctggaagacaaacaggaacaactcgcaactcacagaaccatccgccccgtggatcccggagtcccacagagagggagcacgtgtactgggcttcccagcactcccgccgcctgggccctgtcagccatcgcggcatttgatgtccaggttgatcacagtcccatgctgtatgcaataaataattctgttttct

SEQ ID NO: 1082 - DNA, 2296 bp, Homo sapiens
gaaagaaaacccacaatccagtgtcaagaaagaagtcaacttttcttcccctacttccctgcatttctcctctgtgctcactgccacacgcagctcagcctggacggcacagccagatgcgagatgcgtctctgctgatctgagtctgcctgcagcatggacctgggtcttccctgaagcatctccagggctggagggacgactgccatgcaccgagggctcatccatccgcagagcagggcagtgggaggagacgccatgacccccatcgtcacagtcctgatctgtctcgggctgagtctgggccccaggacccacgtgcagacagggaccatccccaagcccaccctgtgggctgagccagactctgtgatcacccaggggagtcccgtcaccctcagttgtcaggggagccttgaagcccaggagtaccgtctatatagggagaaaaaatcagcatcttggattacacggatacgaccagagcttgtgaagaacggccagttccacatcccatccatcacctgggaacacacagggcgatatggctgtcagtattacagccgcgctcggtggtctgagctcagtgaccccctggtgctggtgatgacaggagcctacccaaaacccaccctctcagcccagcccagccctgtggtgacctcaggaggaagggtgaccctccagtgtgagtcacaggtggcatttggcggcttcattctgtgtaaggaaggagaagatgaacacccacaatgcctgaactcccagccccatgcccgtgggtcgtcccgcgccatcttctccgtgggccccgtgagcccgaatcgcaggtggtcgcacaggtgctatggttatgacttgaactctccctatgtgtggtcttcacccagtgatctcctggagctcctggtcccaggtgtttctaagaagccatcactctcagtgcagccgggtcctgtcgtggcccctggggaaagcctgaccctccagtgtgtctctgatgtcggctatgacagatttgttctgtacaaggagggggaacgtgaccttcgccagctccctggccggcagccccaggctgggctctcccaggccaacttcaccctgggccctgtgagccgctcctacgggggccagtacagatgctacggtgcatacaacctctcctccgagtggtcggcccccagcgaccccctggacatcctgatcacaggacagatccatggcacacccttcatctcagtgcagccaggccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataaaagcaggtcgtctcgttccaatct

SEQ ID NO: 1083 - DNA, 1160 bp, Homo sapiens
  misc_feature (108)..(108): n is a, c, g, or t
ccttcatctcagtgcagccaggccccacagtggcctcaggagagaacgtgaccctgctgtgtcagtcatggcggcagttccacactttccttctgaccaaggcggganaggctgatgccccacagtggcctcaggagagaacgtgaccctgctgtgtcagtcatggcggcagttccacactttccttctgaccaaggcgggagcagctgatgccccactccgtctaagatcaatacacgaatatcctaagtaccaggctgaattccccatgagtcctgtgacctcagcccacgcggggacctacaggtgctacggctcactcaactccgacccctacctgctgtctcaccccagtgagcccctggagctcgtggtctcaggaccctccatgggttccagccccccacccaccggtcccatctccacacctgcaggccctgaggaccagcccctcacccccactgggtcggatccccaaagtggtctgggaaggcacctgggggttgtgatcggcatcttggtggccgtcgtcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgacgcccaggaagaaaacctctatgctgccgtgaaggacacacagcctgaagatggggtggagatggacactcgggctgctgcatctgaagccccccaggatgtgacctacgcccagctgcacagcttgaccctcagacggaaggcaactgagcctcctccatcccaggaaagggaacctccagctgagcccagcatctacgccaccctggccatccactagcccggagggtacgcagactccacactcagtagaaggagactcaggactgctgaaggcacgggagctgcccccagtggacaccaatgaaccccagtcagcctggacccctaacaaagaccatgaggagatgctgggaactttgggactcacttgattctgcagtcgaaataactaatatccctacattttttaattaaagcaacagacttctcaataaaagcaggtcgtctcgttccaatct

SEQ ID NO: 1084 - DNA, 497 bp, Homo sapiens
ctgcagccaacacactgcagagttcctccctgtggtggttacaactgttatttctgtttcatgccagtccaggagaaagcaaagaggaaagtggatgagctataatccgttcacctgaataggcagtgccaggatgtcccccccagcttgcctctcacccgccccgctgctgcccagctgatttgtttgaagtcctctttgatatctatgagagcaccgtggaaggaagaagaagggaggcgaccggagagctatggcctctgtgcagatttttgagttagattaaaattagtaccacctgattaggagcctacctggtgaggaaaaaagccttcttttcaaagtacaaaaaaaagcgatgtgtaccaaggagaaaaccagcagagaaagcttggtggaagaagtgatgttcttgtggaatgtgccagcagcttctccttccagaatgctgacaccagatgaatctttggttagaattaagcctacccctttgtttt

SEQ ID NO: 1085 - DNA, 400 bp, Homo sapiens
taaaactgtctctttgcagatggcatgattttacatacagaaaaccctaaagattccctccagaaaaaaactgttagaagtaataagcaaatttggtaaaacttaagtatacaaaatcaacattaaaaaattagttgtttctatacactaacaaactctctgaaaaagaaattaagaaaaccatcctatttacaatagtatcaaaagaataaactaagaaaatatttaaccaaggaagtaaaagacctataattgaaaactatttgaaaaatgaattgatgaatttgaagtagacacaaaaaacgtgaaagatatctcatgttcattaattagaagaaataatgttgttaaaatgtccatactacccaaaggaacttacaaattcaatgcaatctctatc

SEQ ID NO: 1086 - DNA, 424 bp, Homo sapiens
gtggctgcctcccacatgaagtcctgtctgatgcactccccaggagtctccctctcacaattcccttggactgtgtgcctctggggcagtgccacacctgtcctgccccgcagtgggctctatatttgagtttcctcatccaccgacaaagcacctggcgtgagtgagattctgctaggctggggattctcaggtgagctgaagtccggagttcaagaccagcctggtgaaaccctgtttctattaaaaatacaaaaatcagtggggcgtggtggcacgtgcctgtaaccccagctactcgagaggctgaggcagaattgcttgaacccaggaggcggaggttgcagtgagccaagatcacgccactgcactccagcctgggtgacagagtgagactccatctcaaaaaaagaaaaaaaaagac

SEQ ID NO: 1087 - DNA, 362 bp, Homo sapiens
aaaacctctttctttctcctttttcccataccaccactgatgattccaaggaatttcatatgcatataaatggagaaaacactagtgtgagcctaaggactaggaatgatgaggagtctgtatttctgcaggaaacgttctttcaatgtgcacagtgactaaacttttccattgaaaaaattttccacccggataaatctgccacactttatgagcaaatgcaaaacaggatgatagacactgaacagcctagagacagcctgacctgccttttattgccttcaaggagccaatttgagctctgagcaatgaaatgagtcagtgcttgagaaatgtagaaacaccaggtgaaacttcagaag

SEQ ID NO: 1088 - DNA, 517 bp, Homo sapiens
gttcgtaggtccacagacaggattctctcatgctcaagtaaccctaaaattaaatgcagaattctacaagtatggatctatgcaagatggaaatgtgaagatgcccagagcttccatcagatgtctgaaagggtgcagggcttcaaatgtagcaccacatggatcacggtactaaaatagtatctggatttttatgcttctttgtagtggagcccctgccatgctgagcagagttccagagttaggtgttgaaccatgtccttgccctcctgccaatgagcatgtgtggcatgctcagaggtgctcagggaaccctcagtccctctggtgaagtacaggactgagctgcattctactgactttggtagactcaaggaatctgaattctttctttatgaacccaaaagaaactccagtacacggaaccaccaccttccctctgtccatcactccctcattctctggctctccccaccaggctagacccaaagtcccctgctatcatcccttcttcctg

SEQ ID NO: 1089 - DNA, 679 bp, Homo sapiens
cagtctttagggtacagtagaaccacatgtcatacttaataaaatacagatgttgggcctctccccaaacacctctaaattagagtcttcagtggtagagttcaagcagtgtaaacttttttttcccctcaccaaagttccttaggcaatcctgatgcttatcagaggttgaaaacgactagggtgagattttaggaaagtaaattcaactatagaaaacctcagaatttgtagatttgggtcagtttaaatatttattgtgtgtaaatgttctcttcccaagcaaggttatgttgtaatctcgacatacttagaacaactgccattatatatgtgtttgtatttattcagaatgaaaaaaactaattgactgattgctttcctttatgagccctggggaaaccacttaattttctgcttaacctgtttgagtttccacattcgtgaaattgagttaaatgatgtctcactcattacctcaaaagttgttgtcaggctcaaatgagccaataggctgaatttggaggaccttgattataggctaatattaagttttattaccctgctgcttgtttcttcaaaactatctttgtgtttcctttaaactctccattgccatcagttcttggtttttgatgcttatatatgatattaaatagacttttctcttgctggctta

SEQ ID NO: 1090 - DNA, 350 bp, Homo sapiens
ggacatacaacacagtagttgtgctagagtgatgcataccttttgttacagcattccttagaactgtggcttcctgccctggttagcgatggagtactaataacctcaagcaaaactggcataaaggtttattttgattgctagctctgaacaattgggggtggatgcctggagcactttgggaagcattcagaggttatgaatgatctcaataagaaatagggccaggtgcgatgtaacgcctgtaatccccgcactttggggggccaaggtgggtggatcatttgaggtcaggagttcgaaaccagcctgggacccaacgtggcgaaaccccatctctactaaaaata

SEQ ID NO: 1091 - DNA, 352 bp, Homo sapiens
ggtcgacctaacctgaagcaggtgatgggacaggggtcatcgaatataatgaaagtgccacaaaggtagagtctgggtatattttatttatgcaggtagagtgacttgtccagatcccttcaggttaggataaaaggtataaacaagctgccacctggtgagatggcaggcttccctacaaaaaacaagaaagtaatattctgccatttcctaagaacaagcagcaatgtcctggcttcaaatggtctctagaagtccatgcaccaccgtgcttccactggggcggttgtatcacccaggagcattaggaattgtatggaggtggggtggggcactttctgcttgtcacagc

SEQ ID NO: 1092 - DNA, 416 bp, Homo sapiens
actgattgtttttccacctcctaggagataggtaagtaaagcccctgtgttctaaccaaggaaaccacaaccatagctagtgatgcatcttgaaccacacatcttgaactgtgtgtggtggccaactagtcctagcacttggaaatctgacttccaaacaaaccattatcagactatacttctttacctctagtggagtggatgctgaatgccagtctttcctggaagatacaatcaagaaaaccctaataaaatatcattgttaatttcctgaagaataatttgggaatatttctaagtagataattaacactatacatttcttttcccaaaaataatagtgtataagaacaattcctttaaatctgtttctgatagaagcaattgaatggaccccagatcaggaagtgcgtgta

SEQ ID NO: 1093 - DNA, 328 bp, Homo sapiens
aaaacctaagttgcttttttggttctttgtttgtttgttttgttttgttttttagcaggtaaggccaggtgcagtggcttatgctgaggtgggaggattgcttgagcccaggagtttgagaacagcctgggcaatatagtgggaccctgcctctacaaaacattaaaaaattagctgcgcaaggtgacatgtgcctgtaattccagctactcaggaggctgagatgggaagattgcatttatcccaggaggttgaggctgcactgagccatgaacatgccactgcacttcagcctgggaacagagcaagtccctccttcaccccacca

SEQ ID NO: 1094 - DNA, 182 bp, Homo sapiens
aaagtctgtaattaaagagggaaatgccaattgtggtttaaataaggtgtgactctgggtaaatgaagtcagttttcttgttgtccttaaaagctgtttcataagtttatttccaaagagcatttccaaaaacatttgtagcacagccaatactgatggaaggaagggtgtggcttttttag

SEQ ID NO: 1095 - DNA, 997 bp, Homo sapiens
atttgattggccagaagtctagggtggtaaaaaggttattaaaaacaactcccattccccccaagtcagcttctttctgtcatttttctccttgtagtattcataattcctaaagaatttattcacaaggtattttattgggcagatgccttaaatgtgccaaatgaattattttggttacagactactcaggtacatctaaagaaaattgcccatattcataggtgactcttgtttagcttttttgaaagggaaaggaggatgtgagtatctctgtatcatctcattttatttaatagcagcaagaatattatagtttgtgtttagtttagcttatgattttcatgaatgaaaggaacactgggatcaggccaactatcttactaaaatgcattcctttttaatttagatatcttaaaagcatttatgtgaaaaataactgaacttcattttgacatatcctaaaatgagcagttgaacctcatgcaaaactttctcattctttattagaatagaattttaaaacaaaaaaaccattcaaacagaatatgggcttaaacatcaaggattgaggtgaaaggcctattttttttttaattaatatttttatcttattacccctgccatatggtagctgtttaactttatgaaagccttcgagccttcaactttctaaaactgggaacggtgttgcttgtcatggttctttttgaggatagtgtctatagaggtatgtattaggtgcaattgtcccagttactcttgcaccaacctaatagaataggggctacattcagtattaagtgtcttttttatttttttttaaggttgtgaagaggttgtggtatttgttttataaaatctggtcagtctgaagtttgagacaatatttttaaaatttagctatgagaatcttaaacatgaggtgaggcagggagaaaagatgtaatttgactgagttagtgttgttactcatcacaagtcacataatctattg

SEQ ID NO: 1096 - DNA, 997 bp, Homo sapiens
atttgattggccagaagtctagggtggtaaaaaggttattaaaaacaactcccattccccccaagtcagcttgtgtgtgggaggggtggggggtggtgtgttcgggggggggttgtgggtgggggtggggggggttttgggggggatgccttaaatgtgccaaatgaattattttggttacagactactcaggtacatctaaagaaaattgcccatattcataggtgactcttgtttagcttttttgaaagggaaaggaggatgtgagtatctctgtatcatctcattttatttaatagcagcaagaatattatagtttgtgtttagtttagcttatgattttcatgaatgaaaggaacactgggatcaggccaactatcttactaaaatgcattcctttttaatttagatatcttaaaagcatttatgtgaaaaataactgaacttcattttgacatatcctaaaatgagcagttgaacctcatgcaaaactttctcattctttattagaatagaattttaaaacaaaaaaaccattcaaacagaatatgggcttaaacatcaaggattgaggtgaaaggcctattttttttttaattaatatttttatcttattacccctgccatatggtagctgtttaactttatgaaagccttcgagccttcaactttctaaaactgggaacggtgttgcttgtcatggttctttttgaggatagtgtctatagaggtatgtattaggtgcaattgtcccagttactcttgcaccaacctaatagaataggggctacattcagtattaagtgtcttttttatttttttttaaggttgtgaagaggttgtggtatttgttttataaaatctggtcagtctgaagtttgagacaatatttttaaaatttagctatgagaatcttaaacatgaggtgaggcagggagaaaagatgtaatttgactgagttagtgttgttactcatcacaagtcacataatctattg

SEQ ID NO: 1097 - DNA, 294 bp, Homo sapiens
aactccatcttaaaaaaaacaactactgggatggagttttctctacaggagggttgctgaactgtctggctgtacacctggcattaacagtgaggaccacagggagaataaagccaacacaaaaccaaacaatcacagctgaaatacgcataaaggccatgacggatgatagctctgtttgagaacctagatccagttcttttctggctatttgatttcataggtgtcttgggtcagggcccttagaaacagagcctgtaagacagagccaatgaacaggacttagtgagggag

SEQ ID NO: 1098 - DNA, 325 bp, Homo sapiens
aaagtccctgataatgtgttaatagatagctaatagtttagctttcttaaatcatattatgttttactcagttaaattagccagagttagcaaccttttctgtaatgggaaaaatatagtaaatatttttggctttgtgggccatggagtctgttgcaactaatcaactctgccattgtcatgtgaaagcagccgtagacagtatgtaaatgtgtgggcatgaatgtgttccaatgaaactatttacaaaaataggcatctagccagggccatagtttacctacccctaaattatacatttgaattttattttatttgtttttgt

SEQ ID NO: 1099 - DNA, 635 bp, Homo sapiens
gtccacacggcttttttcacatcgccattcgttggctttctctgctggggctgcttaaattcagcaaaggaaaaaaaacaaaaacaaaaaaacagaacagacactggacgtgagaaatctgaaactggagcatctatgttgttccaaagggtggatctccagagatctccccaccaagaccgcagtccccaccacccatctgtcatgtcagtcgagcagactgacactaagtaagtacgttgaaaatgagctatggatctgggaggacctgggtccttgtgttggttcaagactttctttagacaattcacttcactctggtaacctcagtttcctcaacagtcaaacaaggacaatgatctcaatcatataagagtaaagacatagtatctacgcagggcccggcatatcacttggtatagagtgctgagaaagactatttttgagacgggcccttcctctgttgcccaggctgtagtgcagtggcacaatcatgacttactgcagcctcaacctcctgggctcaggtgatcctcccacctcagcctcctgaggctgggaccacaggcctgcgatccttggttaagttttttattttttgtagcaatgggatttcactacattgcccaggctgg

SEQ ID NO: 1100 - DNA, 412 bp, Homo sapiens
cacttttttatagagatgaggtcttgctttgttgcccaggttgatctcgaattcctgggctcgagcaatcctcctgcctcggcctcccaaagtgctgagattataggtatgagccacctcacctggccttgaatgtgtctctttatggatgaccaggctgtaatatcctactctgcttgcctgcattgacactgatggggcctcagcaagttatgatttacagtgtatgttttgcagatactgttttagctggggcaggaaattcagatagacagaattctgtcctgatcatttcaggcttgctctgtttggctctgttagacttcttggctgaaaataacagagaatcaaagattttggtctcagggatgggaaaaacagggctgcaacatagatttgttaagccattaag

SEQ ID NO: 1101 - DNA, 357 bp, Homo sapiens
attttgaggaatggaaccaacatcagccattaggcctaggaaggccaagatcctgggatggcatcccaaggctcctactttcctcctcacatcgtagcctcaactcatgaccacttatgttgatttggacttctttagttgctctcacttcttccccgtgtcttgatgctcactacctctgtgctgccgtggcacccagcctctgtgccaggctgttgctgtggtctttttgctgcctgtctcttccctcttgcccatctggcctctcctctaggcttccctccattctgccatctataatttgtaatgaaaatttaaccaggcacagtggcacatgcctgtaatcccagctactca

SEQ ID NO: 1102 - DNA, 422 bp, Homo sapiens
agcatttgtggaggctgaggtaggaggactgcttgagcctgggagctcgagaccagcctaggcaacatagtgagaccccatatccacaaaaaatttaaaaaaggagtttgtcttcctgtagtagcagacttgagaggttgaggtggcagtatcacttgagcctgggagttcaaggctaaagtgagctgattgagccattgcactccagcctgagcaacagagagatacgctgtctcaaaggaaatacaaattaaaaaaccagccgggcatgctggcgtgtgcctgtagtctcagctacttgggacactgaagtgggaggatcgcttgagcccaggagttcaaggctgcagtgagctatgattgtgccactgcagtccagcctgggcgacagagaaagaccctgtctcttaaaaaaaaaaaaa

SEQ ID NO: 1103 - DNA, 425 bp, Homo sapiens
atgcacccattccaagttcctccacccacaccccatccccttcctcctgacccccaccgctgcaggagcagagcaccatgggtagtcagggcaacactgggtgcctgccactccacagtggacgataagagccctttgaaatggtgttggcatttggtgtctggtacacacagcgtccccacccaggaatctaggggcacgcagcctatggctcacaggtgctcaggactggcagccgcctaggcgggaaggatccggcggccctctgcctagggtctgatgtcaggtgtcatccgtcagagcagagctgcagactggcagcccctcgcagatctctgcctctgtctcctgcggcatgcaaccataatacgatccaaaatccgcctcaattcattgatggcatttaatcattagcagatttcact

SEQ ID NO: 1104 - DNA, 532 bp, Homo sapiens
ctgcttcctcctcacagcaagccgtctcatctcagaggcttgccttcatatggcatttcctcatttcctccccagtctggctacagcctcacctaactcactggtactgctcttgtccaggtcaccaatgaccttccaattgctaaatccaatggtttgctctcttatcttaccagatcccctccattctacacagtaaactgccacttctcagaggattttcttctctcaggtactgtgacactactctcctggttttccttcttcctctttagccaatcctgtctcctttgctgcctcctccagaatcacaagctctaaagcttggaattccttggggtttggtgctgtgttctcttctttttttcccatccacactggaattctcttcctaggtgatgtcatgcaaactcatggctataaatattatcgatactcatacctgtaatcccagcattttgggaggctgaggtggaagtattgcttgagcccaggagcttgagaccagcctggacaacacagtgagacttcg

SEQ ID NO: 1105 - DNA, 348 bp, Homo sapiens
ttttttttcttggttagtctagctaatggtctgttgattttttttttttcaaaaaagaatctcttagttttgttgaaatttttcttttatttttctagtctgtattccatttattttggctctgatctttgttctttccttccttctggtcactttcagattagcttgttcttctttttattgttccttgaggtgtaacattagattgtttattcatgatatttcttctttcttgatataggcatttattgctataaatttccccctttctgctaattttgctgcatcccataagttttggtatgctgtgtttccatttttctttgtctgaaggcattttaaaatttc

SEQ ID NO: 1106 - DNA, 403 bp, Homo sapiens
gcaggaaagatttggtggtgtacacaagttttctctaaattttctttagtttaaattataaatatgaaatatgttcagggtaaatattcaaaattctgaaatttaaagtcactgctttaagatagatctgggccaggcatgcctataatcctagcactttgggaggccgaggcaggcagatcacctgacgtcaggagttcgagaacagcctgggcaacatggtgagaccaccgtctctacaaaaatacaaaaattagcccagcctggtggcacatgcctgtaatcccagctacttgggaagctgaggcaggagaatcgcttgaacctgggaggcagaggttgcagtgagctgagatctcaccactgcactcttgcctgggtggcagagcaagaatccatctca

SEQ ID NO: 1107 - DNA, 302 bp, Homo sapiens
tcctgccagggccctggcaggagcgtgacaaatatttgttgtggaattaggttcttaagcgatgacgctctgcccagggatcccagggcagctcggcaagtgggcgtgcctcagcaggtgccagttgtccttctgttcccaggaaggggctcttgggttcctaatcagacggcacatggccgggagcagtggctcacgcctgtaatcccagcactttgggaggccgaggcgggcggatcacctgaggtcaggagttcgagaggaacctgtccaacatagagaaaccccatctctactgaaaa

SEQ ID NO: 1108 - DNA, 560 bp, Homo sapiens
ggcttcccccaaaccccttctctgaagtacttgtacctctctgtgtttctacagcaactccctctatgaaaatagccttttaaataacctcctcattcaacctcatgaggttcccatgaagtatgggtgaaggaggaattattatcctctatacacttaacaaaagctcaggagaggaacaccacctatcaaaggtcacgcagcaaagagcagcatgttatgccgagcttcgagcctctcaacagcttccactgtgccagattgggaggcagttcagtggcaacgtggcaaagaatgaagttggtgtgggagacaaattctctggtgaatgagaaatttgagtccccggggtagatagggcagctaagcaacaatgaaagaagcactggcccatgccccaagacctaaaaaccaccgggccaggcctttacaatatcacctacaaaacctctccttaggagacagacaacaggatttttattttttatttattattattattattattttgagacagagttttgcttttgttgcccaggttggagtgcaatggcgcaatc

SEQ ID NO: 1109 - DNA, 720 bp, Homo sapiens
cagtgctgggattgcaggcgtgagccactgtgcctgacccaagatattgcttgcttgataccatgttgaaaattttagatgttttgagttaagtaacattattaaaattaatttcacctctttttactttttaaaaaatacctactaggccgagtgcagttactcatgcctgtaatcctagcactttgggaggccaaggtgggaagattgcatgaagccaggagtccgagaccagcctggtcaacatagtgagaccccatccttaaaaaataaaaacattttttaagtgactgggcatagtggggtgtgcctgtagtcctagctcctggagaggctgaagtgggaggtttgcttgagcccaggagttcaaggctgtagtgagctgtgatggtgccactgcaatccaacctgggtgaaggagggagaccctgtctcttaaaaaaaaaaaatgcctgctagacaatttacagttacatatgtggcttgcatttgtgattcacattatatatttctgttgaacagtactgcctgcacagttggccaggtatggtggctcacacctataattgcagcactttcagaggttaaggagggaggattacttgagcccaggagttacagaccagcccgggcaacaaagtgagaccccatctctacaaaaaaataaaataattagccaggtgtcgtgatacaggcctgtagtcccagctacttgggagg

SEQ ID NO: 1110 - DNA, 544 bp, Homo sapiens
ctattatacaatccacatgtggctgttgaacacttataatgtcgctagtgtgaattcacatgtgatgtgtgaaaaaacacaaaccagattttgaaacctggtatgaaaaacaaaaataatgtaatgtatttatatggatccaaaatgtaatatatatatggatccaaatatatgtatatatatccaaaatatatatccaaaataatgtaatatattgctatatatatatatgtacacacacacatacatatatggatccagttttatactcattattttttctgggtttgtttcacagtgtgtttttgtatgtatttctatcaacttaactaaattagttttctaagtgtcatcatgaatagcataacctgccacgtttatgtaaaacgtgagaaatgtctaaatgaccaacatatataggtaaaatgtttaagctgagagccttatttcaagtctacgttaaatgattacaggcatatatatatatgtgtatacacacacacacacacacacacacacacacacgcatacatatatatagcaa

SEQ ID NO: 1111 - DNA, 578 bp, Homo sapiens
acaccacctgagtccactacaaccattgtgataaaccacagcttgctggtaagctagttttcacttctcattagttgttaatcacttgcttaatatttgagactgcctacaattagtgaaacccccatataagacttatgatgctttcagtatattttttatttacaaatacattaaattcacagcaatgagcagggaggaatagcaaaagacataagatacttacgcatacctgtttcggccttttgactgcagatccactcctgactcagttacgctgttagcagcccagctcttggatataggtcaagctgaccttgaatggtttggtggggaaggtggtaggatttgcagaatggaaactttagaactcaattatgatccatgggttcattaagaattacagtattgtttttggggtgtgtgtttttacaagactggagaagtccagcaaaatgagtgttattttaggtgatatagttggaaaagaaaaaggaaaacgattgttctgtttaccatgtcagttcatttcatagcacagttgaagaccacgtgcagtcttttctattgtgtacaca

SEQ ID NO: 1112 - DNA, 407 bp, Homo sapiens
gttccaggagtacagtagacactcaataaagtatgggcttgttggggctcagaaaacaataccccaaaatgaagacctcagaagtagtttcataagcaaaactttttctctgatcttctcctgccctcctgtctctcaatcccattctttcccaaagctagccatagaaactagaatcactcttccccaaggtgggtcatagaaaccagaactctcattcccagagctagccataaaacctaaaatatgactctaagtttccttccacctttctgtgtaaaaactggccataaataaattacctgagctgtgtgtggtggcctcacacttataaacccagcagtctttgggaggcaaaggtgggaggatcatttgagctcaggagtttgaaagcagcgttgacaaca

SEQ ID NO: 1113 - DNA, 2174 bp, Homo sapiens
tcctcagttctgcatttctgcagagacagaaagaaacgcagctcttgactgcttttttgtaaacattactgtaagagttgtgataactttttattctactatgtatatgtatggaatagtattaataaatgaactagggaaggatgtaataaattagacatctcttcattttagagagaagatggaaacaacattgcttttcttttctcaaataaatatgtgtgaatcaaaagaaaaaacttttttcaagttaatacatggttcaggaaaagaagaaacaagcaaagaagccaaaatcagagctaaggaaaaaagaaatagactaagtcttcttgtgcagaaacctgagtttcatgaagacacccgctccagtagatctgggcacttggccaaagaaacaagagtctcccctgaagaggcagtgaaatggggtgaatcatttgacaaactgctttcccatagagatggactagaggcttttaccagatttcttaaaactgaattcagtgaagaaaatattgaattttggatagcctgtgaagatttcaagaaaagcaagggacctcaacaaattcaccttaaagcaaaagcaatatatgagaaatttatacagactgatgccccaaaagaggttaaccttgattttcacacaaaagaagtcattacaaacagcatcactcaacctaccctccacagttttgatgctgcacaaagcagagtgtatcagctcatggaacaagacagttatacacgttttctgaaatctgacatctatttagacttgatggaaggaagacctcagagaccaacaaatcttaggagacgatcacgctcatttacctgcaatgaattccaagatgtacaatcagatgttgccatttggttataaagaaaattgattttgctcatttttatgacaaacttatacatctgcttctaacatatcgcatgtttatgttaagatttggtcccatcctttaaactgaaatatgtcatgtgaaattattttaaaaatgtaaaaacaaaactttctgctaacaaaatacatacagtatctgccagtatattctgtaaaaccttctatttgatgtcattccatttataatcagaaaaaaaacttatttcttaatcaaaaggcagtacaaaaaaagtaataatgttttataagattgtagagttaagtaaaagttaagcttttgcaaagttgtcaaaagttcaaacaaaagtctagttgggattttttaccaaagcagcataatatgtgttatataaacataataatactcagatatccaaatgttcagatagcatttttcataatgaatgttctcttttttttggtaatagtgtagaagtgatctggttcttacaatgggagatgaagaacatttattattgggttactactaaccctgtcccaagaatagtaatatcacctctagttataagccagcaacaggaacttttgtgaagacacattcatctctacagaacttcagattaaatataatctagattaatgactgagaataagatccacatttgaactcattcctaagtgaacatggacgtacccagttatacaaagtacttctgttggtcacagaaacatgaccagattttgcatatctccaggtagggaactaagtagactaccttatcaccggctaagaaaacttgctactaaactattaggccatcaatggcttgaataaaaaccagagaaggtttttcccaggacgtctcatgtttggccctttagaattggggtagaaatcagaaatgagatgaggggaagaagcaaggagtctaaggccctagcgatttgggcatctgccacattggttcatattcagaaagtgttatctcattgattatattcttgttaagcaaatctccttaagtaattattattcaaataagattatactcatacatctatatgtcactgttttaaagagatatttaatttttaatgtgtgttacatggtctgtaaatatttgtatttaaaaatgccatgcattaggctttggaaatttaatgttagttgaaatgtaaaatgtgaaaactttagatcatttgtagtaataaatatttttaacttcattcatacagttaagtttatctgacaataaaagctctgactgaatgttgattatccttcctattatgt

SEQ ID NO: 1114 - DNA, 2118 bp, Homo sapiens
tcctcagttctgcatttctgcagagacagaaagaaacgcagctcttgactgcttttttgtaaacattactgtaagagttgtgataactttttattctactatgtatatgtatggaatagtattaataaatgaactagggaaggatgtaataaattagacatctcttcattttagagagaagatggaaacaacattgcttttcttttctcaaataaatatgtgtgaatcaaaagaaaaaacttttttcaagttaatacatggttcaggaaaagaagaaacaagcaaagaagccaaaatcagagctaaggaaaaaagaaatagactaagtcttcttgtgcagaaacctgagtttcatgaagacacccgctccagtagatctgggcacttggccaaagaaacaagagtctcccctgaagaggcagtgaaatggggtgaatcatttgacaaactgctttcccatagagatggactagaggcttttaccagatttcttaaaactgaattcagtgaagaaaatattgaattttggatagcctgtgaagatttcaagaaaagcaagggacctcaacaaattcaccttaaagcaaaagcaatatatgagaaatttatacagactgatgccccaaaagagcctccacagttttgatgctgcacaaagcagagtgtatcagctcatggaacaagacagttatacacgttttctgaaatctgacatctatttagacttgatggaaggaagacctcagagaccaacaaatcttaggagacgatcacgctcatttacctgcaatgaattccaagatgtacaatcagatgttgccatttggttataaagaaaattgattttgctcatttttatgacaaacttatacatctgcttctaacatatcgcatgtttatgttaagatttggtcccatcctttaaactgaaatatgtcatgtgaaattattttaaaaatgtaaaaacaaaactttctgctaacaaaatacatacagtatctgccagtatattctgtaaaaccttctatttgatgtcattccatttataatcagaaaaaaaacttatttcttaatcaaaaggcagtacaaaaaaagtaataatgttttataagattgtagagttaagtaaaagttaagcttttgcaaagttgtcaaaagttcaaacaaaagtctagttgggattttttaccaaagcagcataatatgtgttatataaacataataatactcagatatccaaatgttcagatagcatttttcataatgaatgttctcttttttttggtaatagtgtagaagtgatctggttcttacaatgggagatgaagaacatttattattgggttactactaaccctgtcccaagaatagtaatatcacctctagttataagccagcaacaggaacttttgtgaagacacattcatctctacagaacttcagattaaatataatctagattaatgactgagaataagatccacatttgaactcattcctaagtgaacatggacgtacccagttatacaaagtacttctgttggtcacagaaacatgaccagattttgcatatctccaggtagggaactaagtagactaccttatcaccggctaagaaaacttgctactaaactattaggccatcaatggcttgaataaaaaccagagaaggtttttcccaggacgtctcatgtttggccctttagaattggggtagaaatcagaaatgagatgaggggaagaagcaaggagtctaaggccctagcgatttgggcatctgccacattggttcatattcagaaagtgttatctcattgattatattcttgttaagcaaatctccttaagtaattattattcaaataagattatactcatacatctatatgtcactgttttaaagagatatttaatttttaatgtgtgttacatggtctgtaaatatttgtatttaaaaatgccatgcattaggctttggaaatttaatgttagttgaaatgtaaaatgtgaaaactttagatcatttgtagtaataaatatttttaacttcattcatacagttaagtttatctgacaataaaagctctgactgaatgttgattatccttcctattatgt

SEQ ID NO: 1115 - DNA, 772 bp, Homo sapiens
tcctcagttctgcatttctgcagagacagaaagaaacgcagctcttgactgcttttttgtaaacattactagagaagatggaaacaacattgcttttcttttctcaaataaatatgtgtgaatcaaaagaaaaaacttttttcaagttaatacatggttcaggaaaagaagaaacaagcaaagaagccaaaatcagagctaaggaaaaaagaaatagactaagtcttcttgtgcagaaacctgagtttcatgaagacacccgctccagtagatctgggcacttggccaaagaaacaagagtctcccctgaagaggcagtgaaatggggtgaatcatttgacaaactgctttcccatagagatagaaagactcaactgagcaggtgatgcagctagtctagttacaactggatgatgatcaattagagggtgaaaatttcaattgacaataacatatagacaggatttctttcacttaatgaattagtatataataatttcatcatactttcattactcattcaaagcatagaaagatttagcaggatgattagtcctacagaaaatcctcacctagcattctgtaatctttcttctttaaaagtggtaaaaagcaaaaggacaaaatcgaatttgctactctctcttttctctactggtaatattgaagaacagtaaactatctgcaatttaaatcaagaagagacacatttaaagaaatcagcactgacccactggatattatcacttgtcatgattacaatgctaaatat

SEQ ID NO: 1116 - DNA, 2155 bp, Homo sapiens
tcctcagttctgcatttctgcagagacagaaagaaacgcagctcttgactgcttttttgtaaacattactgtaagagttgtgataactttttattctactatgtatatgtatggaatagtattaataaatgaactagggaaggatgtaataaattagacatctcttcattttagagagaagatggaaacaacattgcttttcttttctcaaataaatatgtgtgaatcaaaagaaaaaacttttttcaagttaatacatggttcaggaaaagaagaaacaagcaaagaagccaaaatcagagctaaggaaaaaagaaatagactaagtcttcttgtgcagaaacctgagtttcatgaagacacccgctccagtagatctgggcacttggccaaagaaacaagagtctcccctgaagaggcagtgaaatggggtgaatcatttgacaaactgctttcccatagagatagaaagactcaactgagcaggtgatgcagctagatggactagaggcttttaccagatttcttaaaactgaattcagtgaagaaaatattgaattttggatagcctgtgaagatttcaagaaaagcaagggacctcaacaaattcaccttaaagcaaaagcaatatatgaggaagtcattacaaacagcatcactcaacctaccctccacagttttgatgctgcacaaagcagagtgtatcagctcatggaacaagacagttatacacgttttctgaaatctgacatctatttagacttgatggaaggaagacctcagagaccaacaaatcttaggagacgatcacgctcatttacctgcaatgaattccaagatgtacaatcagatgttgccatttggttataaagaaaattgattttgctcatttttatgacaaacttatacatctgcttctaacatatcgcatgtttatgttaagatttggtcccatcctttaaactgaaatatgtcatgtgaaattattttaaaaatgtaaaaacaaaactttctgctaacaaaatacatacagtatctgccagtatattctgtaaaaccttctatttgatgtcattccatttataatcagaaaaaaaacttatttcttaatcaaaaggcagtacaaaaaaagtaataatgttttataagattgtagagttaagtaaaagttaagcttttgcaaagttgtcaaaagttcaaacaaaagtctagttgggattttttaccaaagcagcataatatgtgttatataaacataataatactcagatatccaaatgttcagatagcatttttcataatgaatgttctcttttttttggtaatagtgtagaagtgatctggttcttacaatgggagatgaagaacatttattattgggttactactaaccctgtcccaagaatagtaatatcacctctagttataagccagcaacaggaacttttgtgaagacacattcatctctacagaacttcagattaaatataatctagattaatgactgagaataagatccacatttgaactcattcctaagtgaacatggacgtacccagttatacaaagtacttctgttggtcacagaaacatgaccagattttgcatatctccaggtagggaactaagtagactaccttatcaccggctaagaaaacttgctactaaactattaggccatcaatggcttgaataaaaaccagagaaggtttttcccaggacgtctcatgtttggccctttagaattggggtagaaatcagaaatgagatgaggggaagaagcaaggagtctaaggccctagcgatttgggcatctgccacattggttcatattcagaaagtgttatctcattgattatattcttgttaagcaaatctccttaagtaattattattcaaataagattatactcatacatctatatgtcactgttttaaagagatatttaatttttaatgtgtgttacatggtctgtaaatatttgtatttaaaaatgccatgcattaggctttggaaatttaatgttagttgaaatgtaaaatgtgaaaactttagatcatttgtagtaataaatatttttaacttcattcatacagttaagtttatctgacaataaaagctctgactgaatgttgattatccttcctattatgt

SEQ ID NO: 1117 - DNA, 392 bp, Homo sapiens
tattctctgggaggcacacacctttcccattttctggtgtgcccagcaataggacgtcgtgttatctttcctgagggtcggacagacgttcgcttgtgagggtaggatcctgctcccttcatagtaagcagaaaatccagtcatattgcactatgggggcccaatctttttctactttggtgaaatgtcctgaatctcacctctgagaatacctttcttgctgtgtcctggcatagcttcctgaaactgtcggaagaggtcttttattccttattgataatctggaaatagggctcttttgaaaacctttttttgtttttccaaaggaaaaaaaaaacccaaagaagataaaacactgaattaaaaagaaatagactctttgtggccgtcta

SEQ ID NO: 1118 - DNA, 295 bp, Homo sapiens
gctcgacagagcaccccacagcagctcagtcatgcacagctcaattacagctccccctgggctggctgatttggtggggatggttcacatggcaacaagtggcctatgccatgttgcctggcctctgaaaaacgtaacttatcatttgtattttcacacaggcactgaaaaggggtcagctatttttttttttttttttttttttggttttcactgcaatgtgaatcaccttgacatttctgtgaaacaggaagtggctggatgatacaacaataaaaataatcacactcaactt

SEQ ID NO: 1119 - DNA, 405 bp, Homo sapiens
ccatctaaacaaatatgggggcaaagaatgggtcagaacatgctttgactacaggcaagcagcggtgcccaggctcccttgagacaagcctccccacgcagtcaccttccactttgttctcagtgatcactccagaagcactaagtcctcttccctcgtctcacaagccttggtaaagctggaaccacatttagggaagaagcctaactcataagcccccagcatcatagggtccagttaagctccacaaagcgctactagcaacaccaaaaccactttcctcaatgctgtgtgacttccacaaagagggggccgacctgggcggagttcaagcttccacaattcaaggaacgaattccacatttaaatgactggattccctcaacagactccctgagtgcccaa

SEQ ID NO: 1120 - DNA, 227 bp, Homo sapiens
aagttgatctgtcacgcttctttctataatttttttatgtgtgtgcttgttttccatcatagccaattagtcttataagctttatgaggctatgttttattaatgtttatttgtccactacctagcacaatgcttgaaatattgaaggtcagcaattcccaattattttctcttttggacacagctttgaatactgaaatttttcatggtacacttgaatgtatttt

SEQ ID NO: 1121 - DNA, 388 bp, Homo sapiens
attaaaaaacatacttaaaatgggggaggagggcacagatctaaggtaaaatctcttgcagttttttcaagttcgcatgcaccgttgaaagttcattagttagggatttaaaagcaaaaatgtttcacacaaccaattaaacgccaagctttacaaacgccttggtctttggttttgggaatctgtaaaagtccgcctccccccacccgagttttgccccttttagagcccctttgttgaattacgtgacttttcccgaagtcatcaaactttgaattgcgtctctaattttttttttcagggcaaaagcaaatcaagaaattaaacttaaaagtaggcgactcggagagaagtgggggaaagctcgccccaaagccaagttccgcag

SEQ ID NO: 1122 - DNA, 1127 bp, Homo sapiens
  misc_feature (1127)..(1127): n is a, c, g, or t
tctcctgcctcagcctcccgagttgctgggactacaggcatgtgccaccacgcccagctaatttttgtatttttagtagagatgaggtttcaccatgttggccaggatggtctcgatctcttgacctcgtgatctgcacacctcagcctctgaaaatgttgggattacaggcgtgagccaccgtgcccagcccaggaacatttttattagagttatccactccctcccagcagtatttatgccttctctcctgaactacaccaaaagctcccagctccctagagggaaaccatgtctaatgcttcctaccaaggagaagccaggagctacactttaaggattcagccattttgtaagctttccctttgcttgcaatcttcttattcttgacttcttcctagcttaaaaagttatagactggtttcaaatccagataattgaagattaacttttcaaatcctcaaacaactttgtagggagaacatttacttggttgattccttcctaccagaatgtacactgagctttagaaaaggaaaaattggtgggtgttgtactcccagctactcgggaggctgaggtgagaagatcacctgaacccgggaggtagaaggtgcagtgacccatgactgcaccactgcactccagcccaggcaacacagtgaggccctatctcaaacaaacaaaccaaacaaacaaaaaaaccccaaaaaccaagcacttctcattctcagaagtggccctacatcacccaaccctttaactctgaccttatctactcccttcttgctctagcttccactaaactccttgcctttcctaaaaaggcagggcatgctcttgtcttaaggtcactgtacttgctcccaaatcccagaattcttttcccccaaatattcacgtctttgtttaaaagattatcttcggccaggatggtctcgatctcttgaccctcgttgatctgcacacctcaagctctgaaaatgtcgggattacaaggcgtgagccaccgtgcccaggccaggaacattctattagagttatccatatccctcgcagccagtatttaattgccttctctcctggctctgtctctgtaaagagtgtgagccacaatgccccaccan

SEQ ID NO: 1123 - DNA, 364 bp, Homo sapiens
aattttcagaccattatatatattttcatgtatatttataataaatagtagtgctaaaagcccttttacatacagtgggttaaattaggtttaatgtatattccagaaacaaggtaataaaatgagttcattccagaccccctataaaatcagtgatatagcatcttacctcacgatcaaacctggcaacagagagcctagccctaaaacacacaaggagattcttttaacaaacaacagtgcttgccttttaaaaatacataatttcaacttttattttagatacagggggttgtgtaggtttgttacatgggtatatgacgtgatgctgaggtttggggtacaaatgatcctgtcacccagg

SEQ ID NO: 1124 - DNA, 319 bp, Homo sapiens
caacattgggtcatctaccgtctaaataaatacggatttcatggtggcatttgaagcacattttgcaaacattatgatgttctattgtcttgctgaattctttattataacactacctcaagacaaatgatagactgttggtaaggtaaattgggttttcaatgtcaggaacaaataaaattttgcaaatagaagtcatcaaataattcaacaggaagaccatactggacacagatgttgtcagttacttctggacaatgtggtaacatggatatttcagtcactggtaacaatgtcagggttaacacccaatgaatta

SEQ ID NO: 1125 - DNA, 390 bp, Homo sapiens
tgttttaaaagtagtaaaagggaccaaaacaatgcttcattttagctcaacatccatctgtaatatgcagtgtaaaatttaattagaatttaataataagaaaagaaaatctgcaggcttggctcagtggctctcgcctataatcccagcattttgtaaggccaatgtaggaggactgcttgaggccaggaattcaagaccagcctggaaaacatagcaagacctcatctctacaaataataataataataataataataataataataataataataataaattagccaggtgcagtggcacacacctataatcctaggtacttaggaggctgaggcaggaggatcacttgagcctaggactttgaggctgtggtgagctatgatagtg

SEQ ID NO: 1126 - DNA, 374 bp, Homo sapiens
gtttgttgcagcactgtttacagtagctagagattcgggagcaagctaagtgttcatcagcagatgaatggataaagaaaatgtggtacctatacacaacagagtaccattcagccataaaaaaaaaaaagggatccaatcatttgcaacaacatggatggaactggagatcattatgctaagtgcaataagccaggcacagaaagacaaacaaatgcatgctcccactcatttgctgaattaaacaaaacaattggccaggtgaagtgtggcttatgcctctaatcccaacactttgagaagccaaggtcaggtggatcacttgagcccaggagttcgagaccagcctgagcaacgtagtgaaaccttgcctc

SEQ ID NO: 1127 - DNA, 143 bp, Homo sapiens
gcaggctttctatttgggcaaggccatctgccattccagtgcacgggcatatgaaacttgccttatcctgaagatatttctgttaaattagaagaagaccattgaggattttcttttaattgtggaagtctgttaaaatagca

SEQ ID NO: 1128 - DNA, 318 bp, Homo sapiens
tgagtgagtgagttgcctttgaaatgaagatgatgtcgggaccccatctaggtgattatcttgttgaatcctcacaaaaactgtgttgatggttactgttgttattcctgatttgtagaggaaagaatcagggtttagcagacaggttaagaaacttgtccaaggtcacatagctagtaaaggcagactctagcttgatttgtggtctgggaaggtctctgacagcacagctgggcgaggggggtgggagggctctgagcttgccccagaggttccgagctggatggcgacccctgagcccccaaagggcttccacct

SEQ ID NO: 1129 - DNA, 463 bp, Homo sapiens
aggaaagtaaattagcaaaacttcctcctggggataattttttaaatatcctttgatctaaacattctttagaaaatttatcttaaggaaataatcatagatgtggttaaatatctagctacagacatgattgttacagtgttgattgcaataatgattaattataagcaacctaaacatcaagaaaagcaaggagtaattaaataatttattgtactgtatgggtatggtatgacttgtgatacagcagttgagaaagatggagaggaccacttaatgacatgaaatgatttttaatattaagagaaacaagattatagtgatggggaatgatccctgtatatttattctaaaaatgtagccagtagttatctctgggtgaagagattatgagcaagtaattttttttatgtgtatttttaatatattctacattgaataggagttacttttgtaatatgta

SEQ ID NO: 1130 - DNA, 566 bp, Homo sapiens
gcccaggatgaccaggggaaaagaggccaaaaagcatatggctttgaactgccaccattgatgtttgggagtagaacaggttctaagatttcccacctccacctgccgggaacttcaattaggaagtaccttccaaggccgtaattctgctatgtcctaggccagaaactaaggaatattagctagaggtagagaaattcaaactttcacaaagtttcctagggcacataatccccccaaaagttattatattgaaccatatgaaaatgccaatatacggctgggtgcggtggctcacgcctgtaatcccagcactttggaaggccgaggcaggcggatcacgaggtcaggagattgaaaccatcctggctaacacggtgaagccccgtctctactaaaaatagaaaaaattagccgggcgaggtggcaggcgcctgtagtcccagctactggggaggctgaggcaggagaatggcgtgaacccccggggcggggcggagcctgcagtgagccgagatcgcaccactgcactccagcctgggtgacagagcaagactctgtctcaa

SEQ ID NO: 1131 - DNA, 420 bp, Homo sapiens
cacattaagccttgggtcattcctgaatttaagcattagttttcgtagtaccttcagtgctgctgcagtacagttctgcctgttacatgcagaccacattaacagtcagctttttatctgtcaactagggcgatgggagaagacccactttacaggatgttaacagttcctatgtatacattcaagaaaaaaaacctggagtcagggttggctccactgtagctttgcctgttaaatcatttctgtcctatgtgccttgagacctcttaaaattgtggccttcatgaaacccccttgtattaagtgttctagtatttataagtaaggaatctgacaaagattcttattatacttttattcatgtaattaaagaagcatgtccatggtaactatgccatacagatgtcaaagaaagataat

SEQ ID NO: 1132 - DNA, 1173 bp, Homo sapiens
tagatggagtctcgctatgtcacccgggctggggtgcagtggtgtgatctcagctcactgcaacctctgcctccaaaattcaagcgattctcctgccttggcctcctgagtagctggaaccataggtgcgtgccaccacgcccagctaagttttgtatttttagtagagatggggtttcaccatgttggccaggctggtctcgaactcctgacctcaggtgatccacccacctcagtctctcaaagtgctgggattacgggcgtgagccagcacacccggcctgatctttcttgcttattgttatatccctatgacaatgacattgcttagtggataataaatactcaataaatatttgctaaaagaatagatgacaatcaaggaggcattgagtacatggacaatgaaacacttgttttctctaacatttggaactttttaaagtgctttaatttttataagcataactattgaacaataatattagatcaaatgtaccaataagtattttgatatttcattggtcattctagggtatttttttaaaagaaaaagtcatgtttctaaaacctaaccaggatctttggtttatgaagtacagtaagtccttaagaagataaatacccctacagaatacagcactcattgaattaacaaggtctagaagatctcttgaagaaattcagaaagaagagatggtggatatacagcagagttaaaccagaactgagtacagttgttggatgatattttcagagagacttcagggtttttcatttaaaatgcggacaaaagaagcttcaatgatggatatttgctcaggcccctactcttatgggcagaatttgccactttactcataaatactatataaaaaagtgatgacacttacaaggagctaggatcctaagaagaaaatatatatttaaaaaattacaaaacagccccttgccacatatgtaatgtgccctattggttcttctttctgatttgtatgtgtatatgtgtatgtttgtttcagaggggaaaaataaggaataccttccatcctatcctaacttgtctttgtatgttaataaggaaaagaccatctctaagccagaaaaatacaaagttcctgaccaagttgaggtcctaaacaagcaaatggaacattggccaacccttatctt

SEQ ID NO: 1133 - DNA, 838 bp, Homo sapiens
  misc_feature (768)..(768): n is a, c, g, or t
  misc_feature (813)..(813): n is a, c, g, or t
  misc_feature (836)..(836): n is a, c, g, or t
agaaagacttagagagtgcactgagattcggaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccttgacgcttgcagcttcggagtcacgggtttgaaacttcaaggggccacgtgcaacaacaacaagctgtcactggtccaatgccatctcaaccggnccttcccctggacgccagctggcttggggtcaagcagacaaacancgggaagaagccagtgttggtanct

SEQ ID NO: 1134 - DNA, 391 bp, Homo sapiens
tcgggcaggacctgcctctttttggaacactttcgagatctttgcgtttgttcgtttccagccatttggtggagactctgagagcctgaacttagaagcccgccgagaggggaaatggcggcctccggggagcgggcagcctggccgcagagcgcgcgggacccagggccaccgtcctcccgagactagcggcagcagccgccactcaccgtgcggaattaaaaacggctactctggttgccacggcaaccagccgtctccccccagcgtcagtttgaatttgtgcagaccattcctagccaagattcaagccaacagattcgtgcttaccctgaggtgaagcctcgtttgagaaccaaataataaaattaacaaacctaaaatctcctca

SEQ ID NO: 1135 - DNA, 464 bp, Homo sapiens
gagacagtcttgctttgtcacccaggctggagtgcaatggtgtgatctcagctcactgcagcctccacctcctgggttcaagcgattatcctgcctcagcctcactagtagctgggattacaggcacacgccaccatgcctaatactttgttttgttagtagagacggggtttcaccatgttggccaggctggtcttcaactcctgacctcaggtgatccacctgcctcagccttcaagagtgctgggattacaggtgtgagccaccacgcccagccctaaggattttatattggagacagactctccaaaatgctaagtactacatctgaaccaatcaccgtctactagaattcctccatgttatttcagaggtcatttgtctcctcttggcttggcttttcttttgcactgggtgcctcaacttgggtggtgaggtaaaaagggaagctagaatctgatttg

SEQ ID NO: 1136 - DNA, 1155 bp, Homo sapiens
tcatgaagggcttcttcctcattgtcttcatgttgagtagggctgaggaggaggaagatgaggggttagtcttgctgtcttgcgggtgacagatgtggaagtaaatcctcatgtaggtgggaatgagcagttcaaacctatgttgttcaagggccaactatagttgattaactcatatctctacagttaattttcaaacagatgtgatagctgaatgagaacttttaagatagtactggacagtaaccttattggaactggaatggcctttagactttttgtgtccagtttcttctcacctcctctttctcttcaaatgtgcaactgaaactgagagacctcagtcccatgtccaaggtcaggcagatacttagcggcagagtgaggactccagcccatttctgcagctctgctgtgcagtggaagatttgggacaagtacattatttaaaaatgcccacccactaaatattacattcctaacttttcccaatacacaaatatgcttgaacttttaaaagcttgtttttggtcgtgcttggtttggaatgtgaatgactaaaactacctttagcaatttcccaaagtgtaagttcaaatgtacagagaatttttttcctgaatgcccaacacaatatgcagttttacaacacataccagattcttagattcatttggtgaaggaagcctctgaattaaaacttttaaatatttctgatttgcaaccagacgaaaaagaagaaaattgacaacttttttgatgcaactttgtgaaatcatggtgttcctggtttttctggtctggtttttgttgttgttttgttttgttttgccacagtttagttcctcacctgatctttccttgtatccacttcagagtctctgaaatgttatctgtttgttggttcctgggaaattgagagccttttcaaagactccatctagaagcatatttaaaagtgtgaaagaagacatttatgcgaccaacaaacatatgaaaaaaagcttatcatcatgggtcattagagaaatgcacagcagaaccacaatgagataccatctcatgccagttagaatggtgatcactaaaaagtcaggaaaggccaggggcggtgactcatgcctgtaatcccagcactttgggaggctgaggcgg

SEQ ID NO: 1137 - DNA, 406 bp, Homo sapiens
ctttttctcatccatccaatgctgtgttagggaaatgactcactcaattaaccatgtcagtggttgcaggggtccttaggtgtgtggtgaccacaggtaacagggatgtgtgacagcaggtgctgaaggtcgggtatggaggtaggtgtttcatcaggtgctcagcccgtcaggccaggcagcttccacatacgccactttgtctctttcctcatctgttttctttcacagcacttacaactgcctgaacattgtttatttacttaaatctagtttatcaaccactagaacacgtcttcctgaccacagttttgtgtctttattactactccatctccaacattgagaacagtgctgggaactcaatgactatttttttgaataaataaatggattaaatttttta

SEQ ID NO: 1138 - DNA, 425 bp, Homo sapiens
ataaaattcaaacaatcaaaactcaactatggttttagaagtcaagataaaggttaacccaggttcgactggggacagagccagtgcctggaactgggcatgagggggattcagaggttctttttcttgatctggttgccagttacatagatgtatttactttgtgctatgcacttaacgatttgtgtgcatttctaaaaatgtgttacacttcaggaaaggttttttttttttttgtaagaggctattctcaaagaaaaactgagtaaaattggtttgagaaaaaaaaaatagtgattatattctgtttatttagcttttccaggagtgtaatgatgcatagggttaacctgggaaacaatgtccctaatgaaagtgtcccttcagtgatctcttcatctaaagaaagtctttatgtcagtagg

SEQ ID NO: 1139 - DNA, 389 bp, Homo sapiens
catgaccacaggccgggtgtcaggccactcgtggcattcaacagccgcacccagggtacacagtgtaggcagcccctgcacgtaagcagagacctaggtcctaagacgatgaaaatggcgtgaaaggtaaacctctattccccacactaggaagggaggggtgggccacagggctggacatcctaagctctgacaattgctatcaggaggtggggcaccaaacgccacccagggagggtgaccagctgtcctggtttgagcaggtttgaaggtcacaggtctaaaacctgggcaaaacaagatacctgaacccccagtggtcagcatgtatacacggggcaaaccgaccttggattttatttgaaacaggtggcattaaggggaaaaaa

SEQ ID NO: 1140 - DNA, 386 bp, Homo sapiens
ctttacctggagggagacagcaggtcttgtatacgttttcactgtgcctgaaaagaaagcttaccattgttcaggtataaaggaacagctaataaagctgtgttgcaggtggctttatgacctatgctatctttttcatctttctaagcaacttaatccatattcgagtaggataatgtgtacaggcatagtttgtgggcagttatacttgtgcttgaacacatggatagaaggaccctggaaaggccatgtactgattggaaacttttcttttgacctggtttgagtgttgcctccagtctggtgggttttttgtgcatttttttgttgtttaattccccaaggcatacaacatccaataaagagttgacagcagtttaacgtat

SEQ ID NO: 1141 - DNA, 405 bp, Homo sapiens
atggaggaagcttttgccctagaaatatagaaataattttcggccatgtgggaaagttaagttggtttaaaaaatggagagaaacattgccttgtctgtccatttataagcccccaaaggtcattgtgtgattaaagaagacataggtgaagtgtgtatatataagtatattcatgtctgttttgtaagtgcacaaaaaagacctaaaagaacacagaatgcactgcgagcagaagtcagtcctgggtagagaagggaatcaagagggttgctgatggtggtcctctatgctcttccctacacaatccgtattctttgtttccagtataatataatgtgcatattgaaaattgttactagatgatggcatggatgcttggctcattaaagtgagattacgaagca

SEQ ID NO: 1142 - DNA, 339 bp, Homo sapiens
ggtggcatctagatagcttcatggagaatccagtgcctcagcaggaggagcagaccccctaacgtgccttccatcatgacctggaaggacacagaactgaaattgccacttggacaagaaagaagatcctcttagaaggcacctgggtgaacagatcacatggacgatcacgtgatactctccccacccagcctccagcactacagaagccctcccagacttagacggaagtctagggaaaggacgagaactccgaggaaattcaaaaatcactgagactgaattttttttccatgcttgagtccttgtgccactggcagtggaaaaaaaatgtcgacg

SEQ ID NO: 1143 - DNA, 451 bp, Homo sapiens
tcatatgagaaaactgagcatgatttgttcgttttgaatgccttaaaccaaatattttaatgtgcattactcacaattagattctaaaaatgtaaaacaaacatgatgctacagcactagtacaaaggcagcaaaaatgcattttaaaagcaggaatactacttcagaaaaatgtattaaaattgaacatgagcttgagaaagtaccgctcagtgcaatcatggaaccacaattaaagctgggcaagacatggaaggtttcctgatagccttgttttataattgtagaaactgagggccgagctcagttgctcatgcctgtaatcccagcactttgggaggcggaggtgggtggatcacttgaggccaagactgtgaaactagcctgaccattatggtgaaaccctgtctttactaaaagtaccaaaattaggtgggcgtggtggcgcgtg

SEQ ID NO: 1144 - DNA, 574 bp, Homo sapiens
agaaggagaaggaaaaatagaagttagtgctagaggatatgttaagatgttctgctcctacatctacatttgtgtctaatcagcattaattgatgactacgtcttggtaaacagtagaccatactggagcaatttactctgctttttgggaattagttctcatttgcactcttgcacctcccataaatactgaactcacttgtagtgttcttagaggtcagcaataaaccatcaagagcatatgatctctctttgaattttgtcactactttggagacagacagtttggaagaactgaaggtactcagcctcagggagaaaggtttgaacgttttggcatagtcctgcaagtcagtttggctccttgactgtgaatttttttaatcaaaaaagattaatatttgaaaccacataatttggacagttaatagttctggtaacataaccaagccttttatctttgtagtatttcattaattagtatccagtgcctcacttttagaagaaaaaaagagaatgctgtattaggggttgttcctgggtgcaaattaatatactgtcttttacatttccg

SEQ ID NO: 1145 - DNA, 197 bp, Homo sapiens
atgaagcaagaggccattggtattgccagataatcagataatcagaagggaaggaatgaggaaccaacagtatctgcttcaagtgagaacaccctcttgggtacccagtagaaagtcgcagacctaccagagccacagatgagaacagatgtgcaggtcatggctcctgtggagagggaagtgcatggcctctcagc

SEQ ID NO: 1146 - DNA, 417 bp, Homo sapiens
tagactcctattttactcagttagttataatccattatttttattgtttattttgctgctcagattgtcccagccctggctgttgttccttttgactcctgtgtccttttacagagtcagtggtcttccctctcccagctctggagccagccatttttccacgtatctctatttccttttagtggagaatggtattcagaaaccaaacttactgtctataaatattattctgtacattctgctgaaagtttaaaagtgttgctttttatatttgaatccttaatctccctgggaatttagcgtatggagtagagggagatatcaaattttcatttttttcacacatatataaccaattatttcagcatctcttatattgaggagttgcttctttacccagatagctacaatgctgac

SEQ ID NO: 1147 - DNA, 222 bp, Homo sapiens
cttatcaagggccaacttattgaattgttattgaatttgagatgaatcaataaagagaaaggagagccatgaaattagaaaaactaccctaattaagtcttcccttctaaaagtcaggaaaactagcattacttgaaaatgagtaccaaaaaaactaaggtcaaatcccatacaaagtcattatgaagaaaaaaagagaataaaacataatttctttagaaa

SEQ ID NO: 1148 - DNA, 361 bp, Homo sapiens
agaaagatgcaaaatcaatctggggaaagccttagtgaagaccctttggcttccaaaaacaggccgagctgggagaagaagggaagttttaggtacctaatttcccagcctcagcaggacctgtcacttggctttaccctgtgtttctcaggaagaaaaaatgagggtcctcactgtcagtcgtgggacatatgtgtctctgtgttttgtcctttaggtgggaggtgtggtgtccgtgggacagaagtcattaagagcagagctgctcctgtaaaataaggccttctgtaccctgtctgcccccgggggctggtctgcccacacagccccttccaagtgccaatgcatggatgtgtctgcc

SEQ ID NO: 1149 - DNA, 423 bp, Homo sapiens
ttttttttttatgagccaagctccaccaaataacaagataaactttgtgtaagacttggtaagagtagagtgtctgacaccttatggtgctataacactcaaagcaaaagcaaaatcgcctatgaccagaaaagggagtcacataggaaatctagaagacctattggctgagagacctgcagcctcatagttcattagctctccatagcaactctcacatgaaatgaagtcagtggtgtttcaagtgcttgaaaccctctttactctacttctaaatgtgaattaattaggcaagtttactagcagttactagacctcaaaagcaaaataatcaggcattattctactaaatattggtctccataactcctctattttcttttggaaaagttagttagtctaagacatttggcataaaggcta

SEQ ID NO: 1150 - DNA, 473 bp, Homo sapiens
atttctgtaaaggtattaagcatatgctgtgctctgtgaaataattttccttaagcttttaaccccttgcctcagatgacctaacacaaaatattaagacctctaatgccaggtgatttactatgaccgcctacatgttctttcaagatattttcagttaacatgcctcctcttgaataaaccatagttgatgagcttagtttttttaaagcatttgatgcagccttttttttttttttttaatgttgtcacactctaattctaatctgagtgcttatggaaatatgctgtggtaagtaaacgttactgataagactccagtagagttagtgcactttcctaactgcccacttgctgcccaggaatgacacagaccctgtccagaatggagtctactgttactcacttgaatataattctctttctaatagtttacttaatgccactcttcagaacaaagtctgtttgacttg

SEQ ID NO: 1151 - DNA, 299 bp, Homo sapiens
agacattggagtgacatatttaaagtcatagggagaaatctcaaacaatacttttatagtcagtgaaactgttctttcaaagtaaaggcaaaatgaaaacatttctagataaacagatactgaatttgttgatagcagacctgcacttatatggaatgctaacagagctccttcggggtgaagataaatgactccagaaataatctggatccaaagaaagggatgaaagcacttggaaaatatgtgggttatattttcccctgtcttcttttaatttatttaaacaaatatgactaaag

SEQ ID NO: 1152 - DNA, 188 bp, Homo sapiens
gcaagcagaaagattttttttcattaaaagatacacacacatacaacacattgaactgagctaatctcaattatactattaaatctctactggttattttaagaaaagaaacataaaagtaagttaccaagtatttaaggtagctcgcctggaagaaaattaggttgtctgaatataaagtgaaggtt

SEQ ID NO: 1153 - DNA, 344 bp, Homo sapiens
ctcactgaaaccagagtccagtgggcctaaattcagtactgaccctacttacctccctcaactttatgagccttgggattctcatctgtgcagtggaaataagaatcatgctggaggtggctgacaaaattaagtgacaagaggacctagaagcagccctccttacagggccactgcatctgagtggagataatgtcaggatgggaagagcagtgacagtcctgctgtccttggattcctagggcccatccagcctagtgcctggcatgcgctgtggccactagagggtgtgtatggcggggcccagcagggcagggctatgctatgacctaagtacaccctcc

SEQ ID NO: 1154 - DNA, 499 bp, Homo sapiens
ggattcttaatagagatggggtttcaccatcctggccgagctggtctccaactcctgacctcatgatccacccacctcggcctcccaaagtgctgggattacaggcatgagccaccacgcccagcctatttgttgtaatttttctacccgcctactaacaccaaagaaacataccaatttttttcaaagtaaatgcttttgctttcgggagctttaagtgataactgaagacattttagttctgagatcgtagtccaaggtccatattctgaaattgtatgtaaaattttgggggttattttgtgccatttttttggggagaagtccatagatttaatcggctcctcagaggggtctatgatgcaaaaagattagcaatcactgccttagaggggcaccagaatgcatcaagacactattgtgaaaagattctatgcctcgcttaccttgagtgcatgatgtcatcataatcaacaatgatcaagcatccgttaattaa

SEQ ID NO: 1155 - DNA, 323 bp, Homo sapiens
tctgccacccactccctctgcatctggggcaagtcgctttgcagacacagctttcccacgtgtgaaatgcagagttgcgtcaggcggtctcggcatcttccagcaggaagaaccttctggaatcagcagtagtccctgctgtcctcctgcaggcctggagacccctcctggaatggttttcctgcctgcctcttcctgctgcataaatgagaagaatccacaggagccccccccaggaagaatggccccctttgctgtgtgtcgactcccagctctgtggctggggcacctctcatgcgcaatgccacccgaccaggtccccc

SEQ ID NO: 1156 - DNA, 229 bp, Homo sapiens
aaaaaataaccaattaaaaatgatctaaatttatactttaattttaacgaatagtattatctcttattatttacctctgataaagtccaaatgtttgtaggcctatagctctggttatatacaatgaaatatctttctcatgagtgtagaatatctagattatatttaatgcatttactttttgaggaaaaggaaacccttaataaaatagcttcaaatatttggtttt

SEQ ID NO: 1157 - DNA, 403 bp, Homo sapiens
tagaggagacagcactgattgcagtgacagaagcggtgccagctaactccccaccatcaaaagtatcttctgctgtagcctggcacaaggtgtgaaatttcatttttaaagatttacttctttgatttgtcattgttatggttaaaatgctataatgctgtctgagggttaaaggacataacttgtgaaaaatcattaatttcctggtgctaatttaaattctttgataattatctgggaggggcttaaaaggagtacaaaattgccttttggaagggtttaattgattgacattgcaatagtctgctcaaagtctgtgagagtatgaatgcctatttgtaaatctgtcatacatacatacacacatatatcagaaatgacaataattatatatagtatacac

SEQ ID NO: 1158 - DNA, 496 bp, Homo sapiens
tgcaagggaaagaattcagagtaaataaacagtctttttctgggaagtaaaatatttccctaagatggagaaattgagatgagagctcatccacaagattacccatcaatgagcaccaatagcaaccaaatccactagaagactgggagcttttaagtcaagaaacttacatcagtatcatcattccaagaagcggtatccaagctgttttatcgaaagtgcgcatgggagatggtgctgtgagtggggagtgagtcaaaaactccgctggggtgtacaaaagtctactcaaatgtccacagcatctgtgggggatggagaatagttggaggatctttctccagaatccttctgttctgtagtacaagtattactcattatagactagcacgaaaaatcaagtgaaatgcgaacttaagagtttaaaaagaataaatggtgcttttctggcctattagtaataaattaaataaaaataattttaatttgtaagtaa

SEQ ID NO: 1159 - DNA, 641 bp, Homo sapiens
  misc_feature (22)..(22): n is a, c, g, or t
  misc_feature (55)..(55): n is a, c, g, or t
  misc_feature (66)..(66): n is a, c, g, or t
  misc_feature (79)..(79): n is a, c, g, or t
gcatacatcatccgccctcctnccgcggaccgcagccgccgcgccaatccggcgnaggtggggccnagcctggcgacanccgccgcttccctccgctcccttcgccgcgcctcggtgctagcggtgcccttgtgagccactgcgttctccaaggccagaacgggacagatggagaaattgagatgagagctcatccacaagattacccatcaatgagcaccaatagcaacctcatccacaagattacccatcaatgagcaccaatagcaaccaaatccactagaagactgggagcttttaagtcaagaaacttacatcagtatcatcattccaagaagcggtatccaagctgttttatcgaaagtgcgcatgggagatggtgctgtgagtggggagtgagtcaaaaactccgctggggtgtacaaaagtctactcaaatgtccacagcatctgtgggggatggagaatagttggaggatctttctccagaatccttctgttctgtagtacaagtattactcattatagactagcacgaaaaatcaagtgaaatgcgaacttaagagtttaaaaagaataaatggtgcttttctggcctattagtaataaattaaataaaaataattttaatttgtaagtaa

SEQ ID NO: 1160 - DNA, 488 bp, Homo sapiens
ctgtaaacactaatacttgggtgaacttccctggttggtaatattctgtgtgtactgccacatatcaataccaggagagtaatgaatcctaaggacacgtgtagaattctccaagactctgccctatgcctttcttcctttggataattttaacctgtattcgttccttgtaatacagtagccacaagtataacaacttgctgtgagttctgtgagatcttctagcaaattgctgaacctgaaagtggttttgggaaccctctgcacttgcaggtgttgtcagaagtgaaggtgagcttgtgcagaggactggccctgtaaatcttgcagtttggctaactctgggtatattgccccagctgcgttatttattagttgtctgccctaggaccagtcacctcaaccttccatgcctcagtttactctacacaatacatactcacttgccctgcctacttttttaataatcaaatgagaaaatgcaatgt

SEQ ID NO: 1161 - DNA, 640 bp, Homo sapiens
taaggtcatagtcacaggttctggggttaggatttggacatatcttttggggggacacagttcaacccactacacccagtgagaagcatgttcagcctcctcttgaatcaagggaaaagccagagtgaccaaccactgtcccagtttgcttgggactgaggaggggtttcccaggacatggggttttcagtactttaggaaaaaaaaatgagagtcccaggtaaaatgggacagttggtcactgtaagctaagcagtgggtatttgggaatttgggatcttggcagacactgctgttccctagggtcttcctacagagttgccttcaagcatgttcatgttaatagcttacatttaatggccaggtacggtggctcacgcctgtaatcccaacactttggaagggcaaggcggacggatcacttgaggtcaggagttcgagaccagcctggccaacgtggtgaaaccctgtctctactaaaaatacaaaaattagctggacgtggtggtgtgtgcctgtaatcccagctactcgggaggctaatgcaggagaatcacttgaacccaggaggcggaggttgcagtgagctaagatcatgccactgcactccacccagggtgacagagcgagactctgtctc

SEQ ID NO: 1162 - DNA, 204 bp, Homo sapiens
aggtttgtgtgagctgcacaaaatacattgatgagcaagggaagcatcgggccagtgcctctctgtccttattttgttaaaggagatggacaattgagtaagtgatgtaattcaacctgaaaagtgaaaagacataaaatcaagtgcagtgttctacagaaagctcaaacaagagcatcaagcccagtggaatgcaggcagggc

SEQ ID NO: 1163 - DNA, 176 bp, Homo sapiens
gaagtaaaccgccccgccaatggctgcaggccaggagtgaagccgacaagaagccctatgatggattttgaggagggctgaagcctgtggactctcaaaatagcctctgctagtggcagttatatttccctttcttgcattcaacttcctttcccaaatgacccagccattagtac

SEQ ID NO: 1164 - DNA, 458 bp, Homo sapiens
atggatggatagtgtaagtctgcactagaattgccatgtaaccgtgttcccataaaagcatcttttgagataaaaacactaatttattttaattagcatacactggtttacttttgaaaagaggagtgccatcttacattgacaatagaaggtgagggaaaaaaaaaagcttaggtcttgctgcctggagctctgtgctctggaatagttaacagccttcctcccagtttactgccctggggtgtgggggaatcagaaatagcaacaagcctttctgcatttgcacaaatgtaattgcttctaatgctacttaagtttcgaagaagccttagcattttcacttcactggagcttttaggttcatttttcctttcaaagtctgcatgtatcgaatgttctataaaagaatgaatacagggggagagagggaaaggaggctatggaaactaactgcttta

SEQ ID NO: 1165 - DNA, 629 bp, Homo sapiens
cattaataatgtgaccagtttttaaaagttttcagtattagaggaaatagccaccccatactacttctactactgcaattactattagcatttttattttttcttttgtttgtgcatttttcacttaatttattttgtttttatcatgcattacttataattattttgacagtttttgtaccctacttttccatgtagcatagatattagtatttttgattggttccttttataagaaaggaagcattacttttatttttggtcagtcataaaactttttatactctggtgtattttatatgtgctgacatagtaatatagtggtgtaaattatgtgtatcattaactacgtagtggttatacatggaattggtgtgaaaatcctggccaggcatggtggctcacacctataattccagcactttgggagtccaaggcaagaggatcgtttgagcccaggagtttgagacttgcctgggcaatctagtgagacccagtctctacacaaaatttttaaaaaattagctgggtgtggtggcatgcacctgtagtcccagctactccggtggctgaggtaggaggatcacttgagcccaggagttcaagcttgtggtgagctgtgattgcac

SEQ ID NO: 1166 - DNA, 376 bp, Homo sapiens
tctggcaaggaattgttcttaataggccaggctgtgatgatgagttaggcaggagactagcagaccaccttgtgccatctgctgcagtgttcgtggcctctcaatgactgtggggcgtcctttactgtagagttagaatcagatcggactcttccacacagttggtggttgttattgagctctgggccaggcactggatatataggagttgttgacatcaaataaactgtagagacgaatctctgcaattcagaagttttacttgagaagtaagaacagcaatttgggctgggcacggtggctcacacctgtaatcccagcactttgtgaggccgaggggggaggattgcttgggcccaggaatttgagaccagcc

SEQ ID NO: 1167 - DNA, 433 bp, Homo sapiens
gtggcaactggtgctgggtcagaaccaagccactgcgtgctgtcgtgggtgcagaagcttagctttggggtagaagggacagtgggccaggggccttccctcaagaagctccagctcactgaaagcccaagcagacccctgaaggactatatctctgtgtgccgagatgctcccctccatgagctccaccttcattgtgcataggacgctgattcttagtacacagcagcaacagagcttcagcagatgccttcttgggaccgcgcttgactctagttccttctccccgggagggagaaagggaaggagcctttgaaatttcccctttcgctatgtttcactggtttttaaacaaatagggctaaatagagaccaagaagttaaccatgtaccttaacgtgcggctttaggcaaaatgttattcaaaaaaaaa

SEQ ID NO: 1168 - DNA, 425 bp, Homo sapiens
tctcgctctgttgccaggctggagtgcagtggtgcgatctcggctgactgcagcctctacctcctgggttcaagtgattctcctgcctcagcctctttgagtagctgggactacaggcgcatgccgccacgcgcagccaatttttatatttttagtagagatagggtttcgccacgttggccaggctggtctggaactcttgacctcaagtgagccgcagcctcctaaagtgctgggattacaggtgtgagccaacacacccggcctaaagatttaataggactttacatactttgagtatatgcagaaaggcttaattattttgctaggtttttaatttaatcatttttattaactatatcaaaagctgggtagtaaaaatgtgataaaaggaagtaagatgtcaacatttaaattaagatggg

SEQ ID NO: 1169 - DNA, 436 bp, Homo sapiens
tactgtgatacctaaatcaaaggcaacagagaatttataggtcagtatcactcatgaatatagatacaaaaagtctttaataagatatttgcaaactaaatctcattgtgtttatataaaaataaataaataaatgaacatgctcaccacatgtgtttatttttggaatctaggatgatataatcagaatgtttattatgtaatttaccatgttcataaaaggtcaggagttcgagaccagcctggccaacatggcgaaaccccgtctctactaaaaatgtaaaaattaggtgggcatggtggcaggcacctgtaatcccagctacttgggaggctgaggcaggagaatcacttgaacccgggaggcggaggttgcagtcagctgagagtgcaccactgcactccagcctgggtgacaagagtgaaactccatctc

SEQ ID NO: 1170 - DNA, 356 bp, Homo sapiens
gcatctgactgatggtgggatctaagtcggtgacctgagcctctttcagttttcatttttttttattttaaatattttatagagatggggtctcactgtgttgcccagcctggtctcaaacttttgacctcaagcaatcctcctgcctcagcctcctgaatagccaggattacaggcgtgagccaccacatctggcctcttccagcttcctgagacattcaaaattattacatcagaaaggctgggcgtggtggctcacgcctataatcccagcactttgggaggctgaggccggtggatcacgaggtcaggagatcgagaccatcctggctaacaaggtgaaaccctgtctctac

SEQ ID NO: 1171 - DNA, 188 bp, Homo sapiens
atatactctgaagaacagagaggaaaaaaaaattaaagttgaaaaagcctcataggagaaaagagacagagcagagaaaaagaatcaaagaaatactaacagagaactttccagatttgatgaaaaacaatctacagattcatgaagcttaactaaccacaactaggaaaacacaaagagagccataa

SEQ ID NO: 1172 - DNA, 542 bp, Homo sapiens
aattcacgaaataaaaatttaaaaaaattttgtgggtgcatagtagatgtatatatttatgggttacatgagatattttgatacaggcatgcatgcatattagtcatgtcagggtaaatggggcatccttttatcctttgtgttacaagcatttatcctttgtgttacagacaatccaactatcctcttatggttttttgtaaatgtacacttaaattatttttaactgttggctgggtgtggtggttcacacctgtaatcccagcactttgggaggccgaggcgggcggatcacctggggtcgggagttcgagaccagcctggctaacatggtgaaaccctgtctctactaaaaatacaaatactagccaggcatggtgcaggcatgcctgtagtatcagctatcaggaggctgaggcaggagaatcgcttgaacccaggaggcaggataatcgcttgaacccggtaggcaaaggctgcaatgagccgagattgcaccactgcactccagccagggctggagcgagactctgactaaaaac

SEQ ID NO: 1173 - DNA, 350 bp, Homo sapiens
tggggacacccagggtgttataaaagcccgataaagagcataacctagaataagagcacagaaagtctttaagggaaggtggggcttaatatgagtaagttttagccagggggagggctttgaggtggatgaaaggaaattctaggaggagggaagagttagtgcaaaaataaagtggcctgaaataactctgtcacgtgagaggttgttcccctgttagactataaacccctcgaggacagggaccactcttaaatcacctctatacacttctcactctcttgcttatggtaactgttcaataaatgtttgtggaatggaatcatatttgagggcaatggaaaaaaaaa

SEQ ID NO: 1174 - DNA, 423 bp, Homo sapiens
agcaacatcataaatataatgatttaactcactgaaaacaaaaattcatgtattcagtgtcagttttaattttgataaaaaatttgtttaaagaataacaaaatgttactatttttcaaatgatgataattgtcacttttagattaaatgatgtataatagtatatcatatattaatggaagatatgatttgacatgaaatcaagcttagtccatgaaaatcaaggtttgtttttttttttaaatagtaaaccatgttcaaatagaatttattttgtaaatgtaagaatgtctaggccgggcgcagtggctcacgcctgtaatcccagcactttgggaggccgagacgtgctgatcacgaggtcaggagatcaagaacatcctggctaacatggtaaaaccctgtctctactaaaaaataaaa

SEQ ID NO: 1175 - DNA, 575 bp, Homo sapiens
gagaacccagacgggcagagcctgggtaggagagcctggccccgctgtccccactgggtggagacaccatgtacttggtccacttgtgctcttcagccaggacaccagacatggtccaaaccgctgcagggctggctgcagcaactccctgacactcaggaaggcccaggctgggcaggcaatacctgctcccaacagccatctcccaggaaggaccctgttgctagtgtggagcaaagacgagtcaagtttatgggctggaagtcctacccggaggctgctcactgagctgtgatggctacaaggacagatggggggaagggtgcagggtgcccgagacctggcccgctggagcctgtcacctaatggctggctggaagaccactacacaccagccagccctggtccattctctcatttagaggcctccccggtggaggcagggatacacaaaatgctttggggctggatgggcccgcctttcagtctaaacaagagacctcaacacagctgcccagaaaaggcagataccagaaatggataaagctggctgggtggggactgtccgaagggca

SEQ ID NO: 1176 - DNA, 1903 bp, Homo sapiens
  misc_feature (1507)..(1507): n is a, c, g, or t
gagaacccagacgggcagagcctgggtaggagagcctggccccgctgtccccactgggtggagacaccatgtacttggtccacttgtgctcttcagccaggacaccagacatggtccaaaccgctgcagggctggctgcagcaactccctgacactcaggaaggcccaggctgggcaggcaatacctgctcccaacagccatgcatgccggctgccgctccaggactcccctgtccccaggaccaagatgacgcccaacagcactggcgaggtgcccagccccattcccaagggggctttggggctctccctggccctggcaagcctcatcatcaccgcgaacctgctcctagccctgggcatcgcctgggaccgccgcctgcgcagcccacctgctggctgcttcttcctgagcctactgctggctgggctgctcacgggtctggcattgcccacattgccagggctgtggaaccagagtcgccggggttactggtcctgcctcctcgtctacttggctcccaacttctccttcctctccctgcttgccaacctcttgctggtgcacggggagcgctacatggcagtcctgaggccactccagccccctgggagcattcggctggccctgctcctcacctgggctggtcccctgctctttgccagtctgcccgctctggggtggaaccactggacccctggtgccaactgcagctcccaggctatcttcccagccccctacctgtacctcgaagtctatgggctcctgctgcccgccgtgggtgctgctgccttcctctctgtccgcgtgctggccactgcccaccgccagctgcaggacatctgccggctggagcgggcagtgtgccgcgatgagccctccgcctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctactgggccccacttctctggatcagagaccctgcctctgtttgaccccgcactgactgaataaagctcctctggccgtttaaaaaaaccaaaaaaaaaaacaaaaaaaaaaaacaaaaaaaaaaaaaaaaaaaaaaaaaagggggggggccgaaaaaagaaaatcccccgagaggagggacccaaaaattaagagaagaacaganggttttctttgacacacaagggggcccccaagaggaagagagcctataaaaaacgaacaaggaagagagggcaggcattaaaaaaacggtgaacagagggggaaaaaaagatcctgctcaacgctacgagagaaaaacttggagagaaggagagacaccctaacacggcgcggggggggcgagcgaaaaaattcgtggggcagaacaaaacacccccctaccaaggaagattattaagaccccacgcggggggaaaaaaatttatacagcattgacagggcgataatagtggcttgttaaaacacaacacgcgccacaaatacatcgccggcgtatagaaaaaaatactggcaacacgagaaaatataattttacgaaacaaaattttctccacgg

SEQ ID NO: 1177 - DNA, 1839 bp, Homo sapiens
  misc_feature (1443)..(1443): n is a, c, g, or t
ttaattgaaaaattctgtgtatcagcgaacatgatacagcccacagcctgcgggtctgcgcccctggattaacatgctgccctgccaggaggacacgacctgcagccccatcctaactctggccaccccatcctgcaggcatgccggctgccgctccaggactcccctgtccccaggaccaagatgacgcccaacagcactggcgaggtgcccagccccattcccaagggggctttggggctctccctggccctggcaagcctcatcatcaccgcgaacctgctcctagccctgggcatcgcctgggaccgccgcctgcgcagcccacctgctggctgcttcttcctgagcctactgctggctgggctgctcacgggtctggcattgcccacattgccagggctgtggaaccagagtcgccggggttactggtcctgcctcctcgtctacttggctcccaacttctccttcctctccctgcttgccaacctcttgctggtgcacggggagcgctacatggcagtcctgaggccactccagccccctgggagcattcggctggccctgctcctcacctgggctggtcccctgctctttgccagtctgcccgctctggggtggaaccactggacccctggtgccaactgcagctcccaggctatcttcccagccccctacctgtacctcgaagtctatgggctcctgctgcccgccgtgggtgctgctgccttcctctctgtccgcgtgctggccactgcccaccgccagctgcaggacatctgccggctggagcgggcagtgtgccgcgatgagccctccgcctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctactgggccccacttctctggatcagagaccctgcctctgtttgaccccgcactgactgaataaagctcctctggccgtttaaaaaaaccaaaaaaaaaaacaaaaaaaaaaaacaaaaaaaaaaaaaaaaaaaaaaaaaagggggggggccgaaaaaagaaaatcccccgagaggagggacccaaaaattaagagaagaacaganggttttctttgacacacaagggggcccccaagaggaagagagcctataaaaaacgaacaaggaagagagggcaggcattaaaaaaacggtgaacagagggggaaaaaaagatcctgctcaacgctacgagagaaaaacttggagagaaggagagacaccctaacacggcgcggggggggcgagcgaaaaaattcgtggggcagaacaaaacacccccctaccaaggaagattattaagaccccacgcggggggaaaaaaatttatacagcattgacagggcgataatagtggcttgttaaaacacaacacgcgccacaaatacatcgccggcgtatagaaaaaaatactggcaacacgagaaaatataattttacgaaacaaaattttctccacgg

SEQ ID NO: 1178 - DNA, 2016 bp, Homo sapiens
  misc_feature (1620)..(1620): n is a, c, g, or t
gagaacccagacgggcagagcctgggtaggagagcctggccccgctgtccccactgggtggagacaccatgtacttggtccacttgtgctcttcagccaggacaccagacatggtccaaaccgctgcagggctggctgcagcaactccctgacactcaggaaggcccaggctgggcaggcaatacctgctcccaacagccatcgaacatgatacagcccacagcctgcgggtctgcgcccctggattaacatgctgccctgccaggaggacacgacctgcagccccatcctaactctggccaccccatcctgcaggcatgccggctgccgctccaggactcccctgtccccaggaccaagatgacgcccaacagcactggcgaggtgcccagccccattcccaagggggctttggggctctccctggccctggcaagcctcatcatcaccgcgaacctgctcctagccctgggcatcgcctgggaccgccgcctgcgcagcccacctgctggctgcttcttcctgagcctactgctggctgggctgctcacgggtctggcattgcccacattgccagggctgtggaaccagagtcgccggggttactggtcctgcctcctcgtctacttggctcccaacttctccttcctctccctgcttgccaacctcttgctggtgcacggggagcgctacatggcagtcctgaggccactccagccccctgggagcattcggctggccctgctcctcacctgggctggtcccctgctctttgccagtctgcccgctctggggtggaaccactggacccctggtgccaactgcagctcccaggctatcttcccagccccctacctgtacctcgaagtctatgggctcctgctgcccgccgtgggtgctgctgccttcctctctgtccgcgtgctggccactgcccaccgccagctgcaggacatctgccggctggagcgggcagtgtgccgcgatgagccctccgcctggcccgggcccttacctggaggcaggcaagggcacaggctggagccatgctgctcttcgggctgtgctgggggccctacgtggccacactgctcctctcagtcctggcctatgagcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctactgggccccacttctctggatcagagaccctgcctctgtttgaccccgcactgactgaataaagctcctctggccgtttaaaaaaaccaaaaaaaaaaacaaaaaaaaaaaacaaaaaaaaaaaaaaaaaaaaaaaaaagggggggggccgaaaaaagaaaatcccccgagaggagggacccaaaaattaagagaagaacaganggttttctttgacacacaagggggcccccaagaggaagagagcctataaaaaacgaacaaggaagagagggcaggcattaaaaaaacggtgaacagagggggaaaaaaagatcctgctcaacgctacgagagaaaaacttggagagaaggagagacaccctaacacggcgcggggggggcgagcgaaaaaattcgtggggcagaacaaaacacccccctaccaaggaagattattaagaccccacgcggggggaaaaaaatttatacagcattgacagggcgataatagtggcttgttaaaacacaacacgcgccacaaatacatcgccggcgtatagaaaaaaatactggcaacacgagaaaatataattttacgaaacaaaattttctccacgg

SEQ ID NO: 1179 - DNA, 1153 bp, Homo sapiens
  misc_feature (757)..(757): n is a, c, g, or t
gagaacccagacgggcagagcctgggtaggagagcctggccccgctgtccccactgggtggagacaccatgtacttggtccacttgtgctcttcagccaggacaccagacatggtccaaaccgctgcagggctggctgcagcaactccctgacactcaggaaggcccaggctgggcaggcaatacctgctcccaacagccatgcatgccggctgccgctccaggactcccctgtccccaggaccaagatgaccagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctactgggccccacttctctggatcagagaccctgcctctgtttgaccccgcactgactgaataaagctcctctggccgtttaaaaaaaccaaaaaaaaaaacaaaaaaaaaaaacaaaaaaaaaaaaaaaaaaaaaaaaaagggggggggccgaaaaaagaaaatcccccgagaggagggacccaaaaattaagagaagaacaganggttttctttgacacacaagggggcccccaagaggaagagagcctataaaaaacgaacaaggaagagagggcaggcattaaaaaaacggtgaacagagggggaaaaaaagatcctgctcaacgctacgagagaaaaacttggagagaaggagagacaccctaacacggcgcggggggggcgagcgaaaaaattcgtggggcagaacaaaacacccccctaccaaggaagattattaagaccccacgcggggggaaaaaaatttatacagcattgacagggcgataatagtggcttgttaaaacacaacacgcgccacaaatacatcgccggcgtatagaaaaaaatactggcaacacgagaaaatataattttacgaaacaaaattttctccacgg

SEQ ID NO: 1180 - DNA, 952 bp, Homo sapiens
  misc_feature (556)..(556): n is a, c, g, or t
acctgggccccgcttctatagaaggtattttagccaaaactggacccgcggcagcgcccgccactggggcctgggacactgttgtccctcctctccctaggaagtgccagtgcagcggcagtgcccgtagccatggggctgggcgatcagcgctacacagccccctggagggcagccgcccaaaggtgcctgcaggggctgtggggaagagcctcccgggacagtcccggccccagcattgcctaccacccaagcagccaaagcagtgtcgacctggacttgaactaaaggaagggcctctgctgactcctaccagagcatccgtccagctcagccatccagcctgtctctactgggccccacttctctggatcagagaccctgcctctgtttgaccccgcactgactgaataaagctcctctggccgtttaaaaaaaccaaaaaaaaaaacaaaaaaaaaaaacaaaaaaaaaaaaaaaaaaaaaaaaaagggggggggccgaaaaaagaaaatcccccgagaggagggacccaaaaattaagagaagaacaganggttttctttgacacacaagggggcccccaagaggaagagagcctataaaaaacgaacaaggaagagagggcaggcattaaaaaaacggtgaacagagggggaaaaaaagatcctgctcaacgctacgagagaaaaacttggagagaaggagagacaccctaacacggcgcggggggggcgagcgaaaaaattcgtggggcagaacaaaacacccccctaccaaggaagattattaagaccccacgcggggggaaaaaaatttatacagcattgacagggcgataatagtggcttgttaaaacacaacacgcgccacaaatacatcgccggcgtatagaaaaaaatactggcaacacgagaaaatataattttacgaaacaaaattttctccacgg

SEQ ID NO: 1181 - DNA, 546 bp, Homo sapiens
aaaaattttctatttaatctatgaaagaagaataatagaattaaaacagctccatttattgatctctaatttaatcagttttgaaggttatcattccttatgctcttggtttggttcagccaggaaaacagccaattaagtattatagaaataaacagtttaatataagaattagcgcttacatttatgtgcatgtaagcaaaaaaaatgaaagtttttttctgcctacagaaagtcagaaacacaatcacaaatgacatcagctgaaaacactgatataggagcgaaagcagtagctcatcaaggagtccaggaaacttctgtattcaccaggattatgaagtacacgcttgtgtgatgtctatgatgggcctatatctggatactagaattgctgagaagaaccttgttaaaaaaaactctgggctgggtgcagtggctcacgcctgtaatcgcagcactttgggaggccaaagcaggaagatcatgaggtcaggagatcgagaccatcctggctaacatggtgaaaccctgtctctactaaaa

SEQ ID NO: 1182 - DNA, 722 bp, Homo sapiens
ctgggctggaagtcaggaggcctggggtactctcagctctgccgctaacatgctgcatgaccatgggctgactggagaacctgaggtgctgtgcagagaccagaggaaggctttgatcccaagcctgcagccgtaagagaagaacgagcccatgagttccagcctgtgggtccttccacatgctagttcctgtacctggaatgtattctttcctgacccagaaaattccttcagggcttcctcttccaggaagtcttccctgagtctgtcacctcttcaccctcactccttctgcatgctcccaaaatcccctgcacttctctactgtggatgcttacccagtgcactgtggtccactctggcttttgtatctccttaactagcagctctgtctttttcattttggattcccagacctatcagagagcctagtgcttgccaaatgctgggaaaatacttattgaaaggatattgactactcggtgttagccacaaggcccctcggacagtcttgccataggaaacatcaatgggagaaccttttggaatatatagagagatgctgtggggaacttatgggtttgttttttttgttgttgtttgtttgtttggctaaactcacagcaataggtgttagagtcatacaagggttacaatagcacccaagagcccacttatgactagaaatttcttccagaattcccttcaaagcatgactctcc

SEQ ID NO: 1183 - DNA, 527 bp, Homo sapiens
ctgggctggaagtcaggaggcctggggtactctcagctctgccgctaacatgctgcatgaccatgggctgactggagaacctgaggtgctgtgcagagaccagaggaaggctttgatcccaagcctgcagccgtaagagaagaacgagcccatgagttccagcctggtccagctcagcacctggctcacattaggcactcagtgaatgttgatgtgaacaaatgaactgattcaaagaagtgtctcctgaagttgcttctttccaatccagctaacaaatgcagtattctgaatggaggtaccagagatcacgtcatcttcagctttctgctgcagatccacatgaagaatcacacatatccttaatgttagataggactttgcattgaacactttaaaatgtgaagtctggctttgaagagggtgtataacacacataatttactgtgcatcagtctcactaatggaaaataaataccgatgcggccgaacaacaatcgccgcccacgacgttctcgacgggcgga

SEQ ID NO: 1184 - DNA, 395 bp, Homo sapiens
ggcccttttatggaatgggagcatccttcatgcaaaattcatggagtcattcttatgagaagttcagcatgcctactcttttctatggtcttagatttctaagaaaaatgtgcatctctaaagaaaaaaagttacttgccaatatataaagccttttaatttgtaccgatgcttaaaaaaaaaagtttaaacaaaacccagatggaagctgtctaaatgcttgggttagaaagaagattgggtcaaatacaatagcaagtcctaaagcaatagcctgctgcagggagtatacatctatccacatttagtctaaatgtagagtgacctttcactaccaagccttgagcttaaagttggctgcagttattggaaatcatttccaaaggtcacttgta

SEQ ID NO: 1185 - DNA, 585 bp, Homo sapiens
tgagatgttatccaagggaagagaagggcttctgacttgtcttcttttcacaagtgctcccatatgttaagtgagtggtgcattttgcaaggcaaagaaagcagtgtctcaattctcacctcaggcttgctgagctgcagagatgtgcagccaaatctccacataaccctgggatgagaagattctgaaacaaactgacatgtggcccctaaagtttggaggaacgtgtgaacattgagatgactgcttcagtccctcctggagaattcagaatgcataatgttggctgatgcagtctataacagcagaaaacaaggagaggagacagtggactgggaggaactacatcccattattagacatgacaagaatgcctgcgtttccatgggctcagtcatcccacagaaagtaatttgctagctttatgagatcccagtgaaaagaaccaccttccagtaaaaaatgataaaggggatatcaccactgatcccacagaaatagaaactaccatcagagattactacaaacacctctacacaaataaactagaaaatctagaagaaatggataaattcctcgacacat

SEQ ID NO: 1186 - DNA, 486 bp, Homo sapiens
  misc_feature (476)..(476): n is a, c, g, or t
  misc_feature (478)..(478): n is a, c, g, or t
ctaaattatatgttttatatgatgaatttataaaagagccacttctcaaataaaatactgttgcaactcatgtgtcttagattttcaaaagcaagcataccagctttcttatacttcaaagtgctgccaccatgaaataatacatttggctagttttgaccaagtaacccagataattgtttccatttggctttacgctgactttggagtcaatgtaatctaagtcagggatcaacaaactatagtcgcaagccaaatctgacctactgcttgttttgtgaataaaattttgcttgatttttgtttttgttttgtgagatgaggtcttgctctgtcaccgtggtttaagtgcagtggtgcagtcatggctcactgcagcctcaacctcctggaggctcaagcaggagaatcagttgaacccaggaattcaaggctgcagtgagccactgtgctctagcctgagtgatggaataagncnctgccatg

SEQ ID NO: 1187 - DNA, 494 bp, Homo sapiens
ctaaattatatgttttatatgatgaatttataaaagagccacttctcaaataaaatactgttgcaactcatgtgtcttagattttcaaaagcaagcataccagctttcttatacttcaaagtgctgccaccatgaaataatacatttggctagttttgaccaagtaacccagataattgtttccatttggctttacgctgactttggagtcaatgtaatctaagtcagggatcaacaaactatagtcgcaagccaaatctgacctactgcttgttttgtgaataaaattttgcttgatttttgtttttgttttgtgagatgaggtcttgctctgtcaccgtggtttaagtgcagtggtgcagtcatggctcactgcagcctcaacctcctggaggctcaagcaggatcacctgagcctgagaggttgaggctgcaatgggccatggtcatgccactgcactccagcctggtgaccctgcgtcaaaaaaaaaaaa

SEQ ID NO: 1188 - DNA, 443 bp, Homo sapiens
gcggatagaaaccagccacattccactgagttccatcacttatgatggtgacagtgtcatccatgtatagtctatgaactcccactgttactttcagctccaaaccagggaaggccaccacacaaggtttgcacctgaggacacggtaacagaaaactggagctgtaggtgacagtttatgtgtagcaaatggggtgaggttagctaggtttccaggctccttgtggattggctaattggaattattttatggactctggagcataagggctctccctagttgtctggtattattagctcaggtacttagtggcccacagtgtgacagcccaacaagagaactagttgggatgtatacttaactgctcaagaaagggaaccgactggcctacagtcagggccccaagactaggttaagacagtgttccaaaagaaaaataaac

SEQ ID NO: 1189 - DNA, 460 bp, Homo sapiens
cgctctgaaaaaaatgaagcaaagtgctttgaggggagggaagtgcagtggcttctttagaaagatagtatggcaaagatctcttggagaaggtgatacgagaattgtaacctgaatacaagagaaatcctactgcgcacagatccttgtgttgcagtttttcttttatatatatttttttccttatttcacatagtctggctttagtttctatgttgtttgtttctcttccttccccatcttggtggtaaattacctcactatcaactcaactcacattacatttctgggagtctttctgtcctggtgtgtatgtgatcagtaatccttacatagtatgtttgctaaatgtgtcctgtctctgtgctatcttcttcttcattgtcaagacccttggtctactactctcctggactccctcatttgcctctgaacttgtctctctgattttgattttcct

SEQ ID NO: 1190 - DNA, 966 bp, Homo sapiens
ttccggcaggaggaaaagctggggtgtgatagctatgtgaccccatgcaaggcacctcctgctctgggctctgtttccctctgtcataaggaagccgagccctagcatcccttctggctcccagaccttccgaactcccactgacaagtggcttggttcaggctttcaacacaggacagataactgcagctcctcccttggcccactgggctctcaggccaggttgggtctggggtctgcaccctctggtcctttttggcttcaaattctattcaatcgtcagcatttcaagtggccacaagcatctctgttgtttcctgaatgccccaggcctggattcaggatttcttattctggagagtaccaggaccctggggtttccgtctggtgtaatttataatggcaaaactcagccagtgggaggtgcatgggtccttgctgcttattttgctgattgacagactgaggcccaggagagggatggcttcctcgagaccctgactctgtgagttagggacaaagctgagactcagtcctggcttcctccactctctgctgttttctttccatcatcctttcctacctcacttgaaaagcctccagaaggccgtatttccctaagctctgcttcactgttgtctccagaagcccagtaaaacaggtgcctctggaaagcacttggtcttaggacagaagctggtgctggaagtaattgggggtggggtacagaacaccggtgtcaagagaaggagactctgtcttcaggacagcagatgcttgtggcatatccttgaacgcccctcacatctctgctctgtctgccgtgcgggagggcatggccaccttgagactggctctgtgcctggagtaagcatgtcacgtaggatcttccttcaatctttacaaccttcctgtgacctaggaaagataatccctgttttgtagagaacataggctcagagaagg

SEQ ID NO: 1191 - DNA, 617 bp, Homo sapiens
taatttgaaggttcttctttagtgctgattgatgttcctaagtcaccatccctaaagctatttttgattattccccatctctgctatcaggagcataatagaacagtggctggaattagagtcactcatgagggagacaggcaaacctgtgtgggttgggggtgtcttcctatgtaatagaaggtctcgtggtggggcatgctgtctttcgtttgaggggatgatgggcctccagttggtggcgaatcttttgaaacttgtttttagcattcccaaatttttttagagaaaaattcagaaagtacaggtgcctttggcgtttcatagtcaatatacaagcgagacacaagtattctccatggatgatttttgtgttgtcatggaatgaaagaaaaataccagtgggtctttactggccataatattttcgttttctcagttggcacatagctctttcgtcgcggaattcacttctttccatcccctctctctacttttaaatattttatgggcagtaagctcacaatatgtgctagcacggctgctctctccagaggtcaggatgggtttaataatgagatgcgtaacagtgactctgtaaaaacccatttcaggtt

SEQ ID NO: 1192 - DNA, 451 bp, Homo sapiens
taatttgaaggttcttctttagtgctgattgatgttcctaagtcaccatccctaaagctatttttgattattccccatctctgctatcaggagcataatagaacagtggctggaattagagtcactcatgagggagacaggcaaacctgtgtgggttgggggtgtcttcctatgtaatagaaggtctcgtggtggggcatgctgtctttcgtttgaggggatgatgggcctccagttggtggcgaatcttttgaaacttgtttttagcattcccaaatttttttagagaaaaattcagaaagtacaggtgcctttggcgtttcatagtcaatatacaagcgagacacaagtattctccatggatgatttttgtgttgtcatggaatgaaagaaaaataccagtgggtgcagtttgtctagtgggtgcagtttgtcagtgggtgcagtttgt

SEQ ID NO: 1193 - DNA, 312 bp, Homo sapiens
cattttacgatagattaattataagtgatgagaaaaacaaaagtgaatgattacatatttttaaatattggcaatgtgcctagtagctttagttttgtgttttaaaagaaaagcagaaatcctgatcactgggtttaacagctaatgaaaagttggtagagaaaaaattaaagtttttgcattgtgctataggaattagacctaaagatttgattccctgactgtgttgtgtgtcggcttttagtgtaaaatatggttttatgagaccacctgatcccatgaaggatgcattatcagaacctgttaaaaaaa

SEQ ID NO: 1194 - DNA, 329 bp, Homo sapiens
tttagggagagaattgtggctatgttacaaacaatctaccagagacttagagacggcagctgtctattccccatttgacttcatcatttatgagcagacgtttgttgagcacatattgggtagcaaaacatctataatattagcttttaattttttaaaaaacttttatttccagaaagcttagctttatctacaagtacagttggtccttgaacaatgtagattagggggtgctgaccctctgtgaagctgaaaaaccatgtataatttttgactccctgaaaacgtaacaatgaatagcctgttgttcactggaagcattgctgatg

SEQ ID NO: 1195 - DNA, 444 bp, Homo sapiens
  misc_feature (169)..(169): n is a, c, g, or t
agttttctaatctgtgaaatgaagtattcttgggccaggtgggctccacatctctttcagttattagatcctatggttatagaaaactagattctcttttgtcgttgttttttgagacaaggttttgctctgttgccgaggctaaagcgcaggctgcactgcacttcgnacctccctggatcaagccatcctcccacgtcagcttcctgagtagcttggactacaggcatgtaccaccacacctgggctaatgtttgtattttttatagagacagggtttgccttgttgcctcggctggtctcaaactcctagggctcaagcaatcttcggcaccttgggccttccaaagtgctggggattacagggcatggaaccaccacgcctaggcctgaaaactaggattcttaactctgctatcatcattgccattcttgaaccacaga

SEQ ID NO: 1196 - DNA, 367 bp, Homo sapiens
gcactcattgcctagcaaccaccggcccttaccccacactgtctttgaaaagctcctgcttatgagccttggatgagactgatttgagtgttaactccacctcccacgtggcgtggctggcctcctgtctgtgaaactctttctttattgcagtgttgtggtctttatttgcgcagtgggcaggaagaaccccttgggtagttacaaaaggtcacctggaaatgaagtgacaactaattaggtatgaatcaacatggtgagcaaaggtcaggggagaggttcacactgcggtgatggatggtctcaaggggttgggtcggatttgcagtaaaagagattttcctggaatctgagtgatgaagaataa

SEQ ID NO: 1197 - DNA, 347 bp, Homo sapiens
tttttttttctgagatagggtctggctctgtcacccaggctggagtgcagtggtgtgatctcagctcactacaaactccgcttcctgggttcaagtgatcctcccacctcggcctcccaactagctgggactacaggtgtgtgcaaccacactcagataatttttgtatttttagtaaggacaggttttcaccatgttggccaggctggtcttcaactcctgacctcaagcgatctgcctaccttgacttcccaaagtgctgggatgacaggtgtaagccaccatatccagcccaagaccttttgcttttagttactataaatctattaaacttgtcaatttacctc

SEQ ID NO: 1198 - DNA, 419 bp, Homo sapiens
tagcacccacctatttaattccaagttagaacaatctaaccctcattctaaaatcctcaacagaaacaatcccctttaatcctatcatgttacagtgcatcgcaggcaatggaatcctactgcattttgagtcttttggaaataggcagtatcatctttgtcttggtattcttaccgtgcacagagtaaacgcttagcaaattattgaaagaataaacaacttgctccaaaacaccagagaagtgccgaatgaggagctgccatgctcaggcagtcattctgcatgattcttattctacaggaggaaatgaagcaagtgtttgccagttggaagggtagaaggaatctttgggagggaggctgccattaccctagctgaagtgaagccaggttaaaaccctcttctggtttaaaaaaaa

SEQ ID NO: 1199 - DNA, 422 bp, Homo sapiens
aaattaaaaaataaaattgcaattctgcctttactccaagaaggtagtggtcttcagagacaaagggtattgcaggtgtgtttactgacttcttcagtgacagcctaatattaggagaaatccacaagcaaagtataccacatttatcctgccttgcccacagatctgtgactttatttttctttttgcctcttcctcttcttccttgctcctgacttcagtgttaagtcacaccatgtctttctctaaattaaaataaatttttaaagaaaaaataaaaatataaaacttgaaaatgttcttaaatctaatgggaaaatgttctgtgtgtttgtcttgtctctgagtttaaattccttgaaagaataacggtatgttacttcaactccttccttggatttcagattaaaatatttaaaaat

SEQ ID NO: 1200 - DNA, 413 bp, Homo sapiens
actctgtctcaaaaaaaaaaaaaaaaaagaaaaaaaaagaacaactttctcctggagtagcctatgtgcgccacctacctaacctactgaatgaaacccagatcctttcctatttctcccagtgtggcactgttacaaggttcagactatccagaaagaaaaggactggaaatagcaaaggctatgcatttgtggagtttgagtctgaggatgttgctaagatagttgctgaaacaatgaacaactacatgtttggtgaaagactcttggagagtcattttatgccacctgaaaaagtacagaaagaactctttcaagactggaatattccatttaagcagcaatcatatccatcagtgaaatgtataatcagaacctgcacttacacaagagctacggatggaggagtgatt

SEQ ID NO: 1201 - DNA, 2486 bp, Homo sapiens
aggctagaggctgaggcaggagaatggcgtgaacccgggaggtggagcttgcagtgagccaagactgcactactgcactccagcctgggtgacagagcgagactccgtctcaaaaaaaaaaaaaaaaaaaaaagaaagaccacaagtaacattcttagttttaaataaaaccctcaaccttctctttgtttgttggacatactaaagatcacctagaattgaaattctttcttctcaaaacattaaatttagttttgtgtctacattttcattttgactttgacatgcatggtgtcagaagtgggatacaaagctgactcacctcatggagaatcattggcctttggagttatggcatgaggtacccatgttggggccctttgaaccccctacacccccaccactttcacaggtaatcctttctccctccagtaagtatctcttggacagaactctcagatatggttcgagttctgttttatttgggatatgattagggagaggtctttccccctcttgtttggtagatctgttgggtagaattattttccccctgttgacctcagctgcgaggtttggaccttgaggcttggatgagggaatttttccctttctttggagaaggcttatcattcttactggtaagcatgtattttattttctgtcctgtcttgtatttatttggcctttgtgtattcagtgcttgcatttacttggcttttgcatagttgacattaaatcagagcacccacgaaatgagctctcaaagttcaaaggcatgccagaatattttctggaactccagctagtaacatattcaaacattacagggatcatttagtctgtttttcttaaaactgaactaaaagatggaggctataaaatcatacactccaaataagatatgcatatttcattgatatcttgagtctaaaaaaaataaaaacaaaaacaaaacacattcaggatacaaatattgccttgttaaaaaatactgtctcaaaggtggctgaaactttcttttctagacctttcccctccccttcttacagtatcccctctttatccttctctaaacagctattctaacatactacttaaataaaaacacttgaaaaccagcagatataaaacaaagtcattttgaccttcctactgttttttttttaaagcaaagattaaattcccatgtaaaaccttcctccctatacaaaaaagaatagcagcatttttatcttcaatgacaaagaattgagtccaagaaaatactgtataaaccttgttaaaaatcactcttgtcttttggtcctactcacataattcagcacactttcacagttaactattttttgttcaatttagtgcactggtgagtgactcaaactgctttatcccaaatttgatttacagcctttataagattgcctattaaaaaagcttaaagcttatccttagcccattttgtcagaaaaataatttgcatctaatcatttttataaactggtgaatttacgtgttttactatatcatgactaaaattctaaaataaaagttttaatatctttatgtatatgtgtttaaatgtgtttatgtgtatgtacatatattatgttgaatgttgtatctacataaaagctggtgtagtcagccagaaatcccttaacaaattttattctgattggtttaaataaatgagcactcatataaaatgtatagtaattaacccccagttttttttagttgatgtgacttaagtaaatctttgataaattaattggttttaaaattgtggataaaataaaattagaaatgtcttcaaaattgtcagcagacatttttgtctgggtttactggtcagacagttttatatttgcctctgctagatgttttaaagtcataaagcctaaaacaaaatgatctttgtttatatagtttttaaataaatatgattatattgttgttttaataaaaatagctgtaacttttctgagttagcaacagggtggctgtttttaactttaaggttcttacttaaaccttaatatcaagataaatacttcatggtaacagtctataaaactgattaataaaaacaatgactagttctatctcaattttcataaatctaggaataattgagaaataaatcttataaatgaaataaacatttataaatgagcttttcatgtaattttaaaatcttaaaattatgttaaatgatactcattaaatgtctggatcatatccaaattaaaaaaaaattgctaaatacatagacatttgttcttggcttcttaggttttataaaaggactaaaagtatttcggtctattaatcaaaatataaatttaggaaaatacaattgatgtattaaaaattatatggtaaatttttatcctaagataaaataattggttgttaaaaattttattttttatttttattttttgagaccgagttttgctcttattgcccaggctagagtg

SEQ ID NO: 1202 - DNA, 289 bp, Homo sapiens
tctcccctgcatatggaagattgtatatgtgcccttttcccccctgaatcatttcaaagtaagttgccagtatcagcatttcagtgttaagtactttcgcagatatcttctaggaaccaggacgttctcctatataatcacaataccattaatcccaccccaaaaatttaacatcaatacactaatgatacctactgtatagattataatcagctttcttgcagtaatctgtttagaaggcttgcaccctgtcaccatccactgattaaattttgaactctaacttgaa

SEQ ID NO: 1203 - DNA, 6494 bp, Homo sapiens
cgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggcaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagaccgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccagtggcgtggctcctttgaggaaataaaacactaagcatga

SEQ ID NO: 1204 - DNA, 6246 bp, Homo sapiens
cgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggcaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagaccgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccagtggcgtggctcctttgaggaaataaaacactaagcatga

SEQ ID NO: 1205 - DNA, 2245 bp, Homo sapiens
tgtacctgtttcagcacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagaccgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccagtggcgtggctcctttgaggaaataaaacactaagcatga

SEQ ID NO: 1206 - DNA, 2182 bp, Homo sapiens
tgtacctgtttcagcacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagaccgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccagtggcgtggctcctttgaggaaataaaacactaagcatga

SEQ ID NO: 1207 - DNA, 5740 bp, Homo sapiens
cgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggcaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagaccgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaagttcctttcggacccgcaggtccacacggtgctggtggagcgctccacgctcaaagaggacgtcggtgatgaaggagaagaagaaaaagaattcatttcctataacatcaacatagacattcattatggggttaaatccatagcttggcaatcattaaggactcccgtgacgatcataaccgt

SEQ ID NO: 1208 - DNA, 369 bp, Homo sapiens
gctatatttcacagacagcacaggtggggtttgtgtattttcccggaaaccctctgtctggggagatacagcctgacctgaccgggtcccccactgagcaggaggccgggtcgctgggaaggaggacaaacctgtattccatgactgggtctgtctcggagctggtaagcacatgtccgctctgtgatgagccctggtgggctccatccagaccctccttgtgatgtttttgtagattttctgcccttctgggtccaggcccccttcttctgctctggcaaaagtgtcttactcataatgataatgacaacgagaattcccacacctggcatttgtaaagcactttgctatttagaaacaaaaactttt

SEQ ID NO: 1209 - DNA, 472 bp, Homo sapiens
cagtgaatttggttgttcttcctgcctggggtggtcagtttccaagcctttccagatggacttctgcagcccaaagctgcgtgctccccgtgcaggcccttgtcagagcagagaaagatggctgaagttgttgtccatctagatttttatcttcaaaacattgctgaaatcaatctctcttctaccgtctccgatttcctttgtccttatgggtggtctacaactttactatcattttagtggatgcaagaggagtggagataaacacgtgttcagcctgctgtgaatctctgcagtggctatgttgtttcttaaacagatgtaatgaggcatctattccctgtgtgccatgtgccccttgagtaggggacatctgttttgtgttgtctgtgtctccagcattagaatggaacctggcacacaatagaggctcaattagtatttgttgaataaatgaacattaagaaacaga

SEQ ID NO: 1210 - DNA, 422 bp, Homo sapiens
tccaaaagtttactttctagccccgggctgtccactgcagaagccaccaccacctgtgcactaccgggtacttgcaatgtggcatgtgtcactgaggaaacacattttcaatttcattcatttaaattcaatctattttattttattttgagatgaggtttcactccgttgctcaggctggagtgcagtggtacaaccacggctcaccacatccttgacttcccagcctcaggtgattcatgtctgaaatttattaattaaaaaataaatgtattaacaggcatgccaccatgcctactaatttttaaatttgttttgtagagacagggtcttctatgttgcccagactggtctcaaactcctgggctcaagcgatcctcctgccttggctccccaaagtactgggattacaggtgtgagcc

SEQ ID NO: 1211 - DNA, 416 bp, Homo sapiens
aaagtgtaaatctagaactgctaatttagtaggcttctttctataagtagcaacaagcttttaaaaaaattgtttgcaataaaatatccagtggaaacaaatttagtggtttccatttgaaaatgtaacttttaaatatcaaaaacaggaagcagcacagcagcacagcttagaagttacagtgtggatccgctgtgtgaacctgatgagttctttgagaaactctttgagtttctgtttgacctctttaacaacaagactataaaagtgaggcagtgtagccaagtagctaagaaaagaggcattagagaggctgaagcaggaggagaatcgcttgaacccaggaggtggcagaggttgcagtgagctgagatcgtgcatttgcactgcagcctgggcaacaagagggaaactca

SEQ ID NO: 1212 - DNA, 219 bp, Homo sapiens
taatcttttaattttatttcattgagaaataaaaacttctaattgttaaatttcattttctcaagaaatgttaatttcaaacaataatggtataaaaatatccataggatgaattttttctcaaccttgacctgaaacatgtgtttttaggaaattaaaaataactaatagcttcgacaactattcagtaatacttcttcagtattacttcagtattca

SEQ ID NO: 1213 - DNA, 371 bp, Homo sapiens
attatacccttactggtttttttgtttgattgttcagtctatacttatgttttgcttgagatgaaattatttctctggctgcttagagctactttcaatagattcagtcttttacattgattttatcattttagattcctacactcttttgttttgattccttgcttgtgtgactggatttcattgttaaatagttttttcaaaatgtgttttaagaaagtatgatttttgtttaaaaatgtttacctgtggtttttataccacaggtatggtatataccacaggtatgggtagatcttttctttttctcagaatctggtatatgttattccaatgtcttctggaattaaattttctgtggataagtcatc

SEQ ID NO: 1214 - DNA, 667 bp, Homo sapiens
gaattaaaaaaaaagaagaaagcttcacagaatttcctaaagaaacttctgactccctttcccttaccctttcctcttcttaatgctctgttacgaaagaaaaagctgatgttgctgttgagagtctcataccaggactggagcccccagttccccagcgcctcccatctcagacggaatctgtgacctcgaatcgcacagattctctcaccggggaagattccctgcttgattgctctctgctctctaaccctactactgaccttctggaagagtttgcccccacagcaatctctgctccagtccataaagctgcagaagatagtaatctcatctcaggttttgatgtccctgagggctcggacaaggtggctgaagatgagtttgaccctattcctgtattgataaccaaaaacccacaaggtgggcactctagaaacagcagtgggagctctgagtccagtcttcccaacctagccaggtctttactgctggtggatcagctcatagacctgtagccgtgacccagtagcagatgcagttctgtaaccttcataccgtaaaatacattttcattacggagttatgaaaaaaatgatttttttaaaaaaatctgcaaataaggggccctccagcccttttctcctaccccttgccttctcctgta

SEQ ID NO: 1215 - DNA, 329 bp, Homo sapiens
gctgggattacaggcgtgagccaccgcgcctggcctccatttatttgtaaatagataattctcaacagtatgtttactctggataaacatcagtcagtgcgtagaactggtaaatgtcagagaaatgtatcacttatcagagcgtctcacagtctagtcctgtatttcttctgaactcacgctctgcaaagccagggctgaatgtatctaccatacctgcttgtttacctccaaaccttgcaatacatttatacaaaatatttatttcacagcttatcttaaaacaaatgtaaaaggtatcttcaaataaatcagactgaatctctaac

SEQ ID NO: 1216 - DNA, 472 bp, Homo sapiens
caaatgcacccctttgctgcctcgtccttggggtggtagtgcttcctccatgataccttcttagcatctctgacattagtgttaaggggtcccaacccctaacatgagtttcctggactgtggggggccttttgtgcccttctgagccctggggagatcaaaagcagttgtctaacccctcggtggttagtaactgctctactctgagaaagaagggctggcttatccttggagaggccagtaattctgttctcagctcttctctctgcgggcctccacatctcaggaagaaaggacaggtgccatctcagttccagtcatcttagcacacgcctccctctctgcctccctgctgatctgcaccttagctgtggcctggcctggtctcaaaatgctcccaggaggagaggccatggccttctccatgcccaccctccctcaccaagtgtgagcagaactgatggagaagctg

SEQ ID NO: 1217 - DNA, 780 bp, Homo sapiens
ccagtaaactttctaccaagaatggccagtgtaacatgttcatttagattagtgttgccagtctctctgtctccttttctctttgaagtgttgtttgccaaatgatatggtaagttcaaattactctttaggtatttccttttcatttttaaattgccaagcactgtactttccaattaggttctaaaattcaatgttaagtggaaacatttgttaaatttctaaagcataaaatatttgattattctcttcttagatgttagtttacataattaatagtgggtttttatttaatatgtgttatgttttagctctttgatcaggtatacacattatcttgagttttcacatccaaaaaattatatacacactgttcacaggcttaatgtgaagaatgtgatgtaagctatgtttaaattattcttataaaagtgacttttgacctatgatttgatagtattcagctgttaagtcatacatgtaatgtatcatttttgtttttaagtttgaggtctcactatgttggccaggtgggaggatcactcaaggctagaagttcgagaccagcctaagcaacaaagcaagatccctctctctaccaaaaaaaattaaaaattagctgagtgtggtggcatgcacctgtagtctgtagtcctagctactcatgaggttgagacaggaggattgcttgagcccaggagtttaagactgcagtgagttatcactgtaccactgcactccagcgtggttggcagagtaagaccctgtctctttaaaaaa

SEQ ID NO: 1218 - DNA, 571 bp, Homo sapiens
  misc_feature (481)..(481): n is a, c, g, or t
gtttgctgaatgcatagcaaagtccttgtggaaataagtttgtttttataatctttttctttttgtcctctttgtaaatggcctgaacagtacactatataataatagctaacgttggtggggttagggaacactctgttaaaaatatgttgatgtattatctagtaaaaggtgagaaaaatcttcattttaagagtaaaaatatgtcacatgcctggcatggtggctcacacctgtaatcccaacactttgggaggcccaggtgggaggaggggaagcagaggggacgatgagttgacttttgctgatggagcctctctgaagggcaaatttcaaagtacagctgggtgctgcagcactggagtgcgaacttgtgggctgtggttatgaaggagcctcgtcagctatacctttagcccctggtgaagcagtgccagtcacacttttgccagtcaaacggagagggcagcagtagtaagancagaccaaatcaaaccaaaccaagcccacggggaatggaggtccatgtgagcacacagcatggcagctgcccacaagccaggaagaggct

SEQ ID NO: 1219 - DNA, 363 bp, Homo sapiens
tttgataattatggcagttcctcagttaattttttacttttactcctgggctcaagtgatccttctgcctcagcctcccaaagcgctgcaattacaggctgagccaccatgccgggcctttagttcttagtagctccttagttccctgttagttacttagaattcacttcttcatgcataacacatatgattaggtatgtagatggcctctgaaaagaatactcctttattcatatatcctgtaaaagtaagccctatcttaagtaattgtgcaaaaaattctttagaaactaggagcgattagtaccactacccattcaagttgttcaagctagaaattttaagtcatcttgtattcttctt

SEQ ID NO: 1220 - DNA, 2215 bp, Homo sapiens
catcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattatt

SEQ ID NO: 1221 - DNA, 423 bp, Homo sapiens
gtcaagctgagctctcagaagacccccaagccccagaccaaggagctgaatgcacttgtgcatgcggcaggagcctacctagaggccctctcccacctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattatt

SEQ ID NO: 1222 - DNA, 1544 bp, Homo sapiens
catcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattatt

SEQ ID NO: 1223 - DNA, 621 bp, Homo sapiens
ttttttttggtggttttcttaaaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattatt

SEQ ID NO: 1224 - DNA, 2238 bp, Homo sapiens
catcaaaatatgaagtcctgacagttcaagagcctccaaggattgaagatgccgaggaatttcccaacctggcagttgcatctgaaagaagagacagaatagagacaccgaaatttcaatctaagcagcagccacaggataattttaaaaataatgtaaagaagagccagcttccagtgcagttggacttggggggcatgctgacagccctggagaagaagcagcactctcagcatgcaaagcagtcctccaaaccagtggtagtctcagttggagcagtgccagtcctttccaaagaatgtgcatcaggggagagaggccgccgcatgagtcaaatgaagaccccgcacaatcccttggactccagcgccccactgatgaagaaagggaagcagagggagatccccaaggccaagaagccaacctcactgaagaagattattttgaaagaacggcaagagagaaagcagcgtctccaagaaaatgctgtgagtccagcttttaccagtgatgacacacaagatggagagagtggtggtgatgaccagtttcccgagcaggcagagctgtcagggccagaggggatggacgaactgatctccactccttcggttgaggacaagtctgaagagccaccaggcacagagctccagagggacacagaggcctcccaccttgctcccaatcacaccaccttccctaagatccacagccgcagattcagggattactgcagccagatgcttagtaaagaagtggatgcttgtgttaccgacctactcaaagaactggtccgtttccaagaccgtatgtaccagaaagatccagtcaaggccaagactaaacgtcgacttgtgttggggttgagggaggttctcaaacacctgaagctcaaaaaactgaaatgtgtcattatttctcccaactgtgagaagatacagtcaaaaggtgggctggatgacactttgcacacaattattgattatgcctgtgagcagaacattccctttgtgtttgctctcaaccgcaaagctctggggcgcagtttgaataaggcagttcctgtcagtgtggtggggatcttcagctatgatggggcccaggatcagttccacaagatggttgagctgacagtggcggcccgacaggcgtacaagaccatgctggagaatgtgcagcaggagctggtgggagagcccaggcctcaggcacctcccagcctacccacacagggccccagctgccctgcagaagatggccccccagccctgaaagaaaaagaagagccacactacattgaaatctggaaaaaacatctggaagcatacagtggatgtaccctggagctagaagaatccttggaggcttcaacctctcaaatgatgaatttgaatttatgagagttcttgcctgtgtgtctgtattttgggtaaggaggggaggtctgaaaaagactttggggctttttcttctgtttttcatgacaatgtaatttgtgtaactgttgaatctggaaattgatcagcattaaagggcacatgaagcagtgtctgcaggcgttcagtgctgcggagcctgttaaaggtcactcagatgtgcaggtgttaatcttctctaaaagcctggtgatacagctctggctttctgagcacactacggatctggaaaatactggaaaatgtgatacttagaatactttggctgctaaggaaacttcctctccattgcagaatagctgagccaagtgagtgagtttgcagaaagcaggtggtgagctcctgcctgctggaggttgccatggagggccattcctgcccggcaacagcaccgtcctgcagggagccacttggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattattaaattttgtttcagactctggtg

SEQ ID NO: 1225 - DNA, 458 bp, Homo sapiens
acataaagttgtgcaaatactaattttatcggatgactgaatgcattatcacacagtcatgctcggtttgaacaacaaagtggccaatagtggcagaagggtgcagggctgctggtgtcagagcaagagggctacagggaaagggccctttctcaggggatgtagcttttttaaaagatttgggaacacttggaggatttgctaaaatgagcctcagaaggaaaattggttttctaacctgtgactttttgaaatgaattattcctttcagtctttatttttcaaagaaacaatgtgtattgaagtacctagatttgtttgataatcaacaaatctttcctttttcaatgaacatattctgaatgtggtttctgtcttagaccaggaggacagagtttgctttcatattttccctgtaagtaagagggcttatttattttaaataaagagtaattatt

SEQ ID NO: 1226 - DNA, 1161 bp, Homo sapiens
ttttttttagtgtatttttcgtggttggatcaaaaagacttgagtttttaatttaatttattccctgccgttgtagcggggcggggtccctgtgccctggcctgggggaggggaacgcggaacatggggtcgggaacacagccgctcccctctgctctgcaccccactcgtgggggaacacagccgctcccctctgctctgcaccccactcgtgggggaacacagccgctcccctctgctctgcaccccactcgtgggggaacacagccgctcccctctgctctgcaccccactcgtgggggaacacagctgcagcccaccgcggacccccctggtgctccaggttgggtgagtctgagccggaaggggtacgtggtgggcgcccctcattgtggctggggagacctcataccccatcgcccacccccgtcctcctggtcatttcctcccagacactgttttgccccagcgcccttcggaatcacagtcccgccgtgtcttagaaactgctttggccgatgcaaacagccccctacccgtccccctcgcctcacacggtccctctccgaggccgagaagaccttctgttcctgtaaatacagccagcaagtgcaaactgtgattttattttccacgtattcctgaggacggactggaccgtctatgttttttcagcccttcatagggggtcttttattttggtgggggggtggggtggacttttagagtagaagctgcacttggcaataagctcgtgtcgtctgtcagagcccctctctcaactctgtgacctgataatgtttctaagaaaaagaaaaaaaggacaaaagggagggaaccactaccaaaaaaaaaaaaagaaactcctccccgaagacactttaatgaaggaaacaacacatttatacggatttcatatttctacccgcctttcctgactctgtgttttatatatattatatataaatatatattgtgtacggccgccggccggcggctcgaggcacgcccggtggtggggggtgggcagagggcttttgtagggggtcggcggggcgggccgcgttgccaggcctggagctggcgaccgggcctccctcttcccgtcacaatcaactttggattctgtatttttttataataaaatgagcataaacctca

SEQ ID NO: 1227 - DNA, 748 bp, Homo sapiens
ttttttttagtgtatttttcgtggttggatcaaaaagacttgagtttttaatttaatttattccctgccgttgtagcggggcggggtccctgtgccctggcctgggggaggggaacgcggaacatggggtcgggaacacagccgctcccctctgctctgcaccccactcgtgggggaacacagccgctcccctctgctctgcaccccactcgtgggggaacacagccgctcccctctgctctgcaccccactcgtgggggaacacagccgctcccctctgctctgcaccccactcgtgggggaacacagctgcagcccaccgcggacccccctggtgctccaggttgggtgagtctgagccggaaggggtacgtggtgggcgcccctcattgtggctggggagacctcataccccatcgcccacccccgtcctcctggtcatttcctcccagacactgttttgccccagcgcccttcggaatcacagtcccgccgtgtcttagaaactgctttggccgatgcaaacagccccctacccgtccccctcgcctcacacggtccctctccgaggccgagaagaccttctgttcctgtaaatacagccagcaagtgcaaactgtgattttattttccacgtattcctgaggacggactggaccgtctatgttttttcagcccttcataggggtccgctttttgattcaagccttttactactgcactacgagggggcccttaacatggccta

SEQ ID NO: 1228 - DNA, 235 bp, Homo sapiens
tgtatgaactgaaaagccattggagagttcagagcagaaaagtgacatgatctcatgtatattgtatgaagagctctgactgctattttgaggctaggttgaggagggcaaaggattaaagcagagatgagttagaaggtcttgcaataatccatgtagaagagatagtgacaactcagaacagagtggtagccatggaggtgatgagaagcaactatctcctagaattactttg

SEQ ID NO: 1229 - DNA, 580 bp, Homo sapiens
aaggcatacatactaacttttttgattaattccacccatgtaccctgatttgggcagaattttaatctcactgtgaaatcagagctttgttctagagcctttcttgggggttccatggatcagtgggtcagccgtcacttgtgccctggcccatcctctgtccagcttgggcagcatgcatcattcattctgattccttaatttgccatatgtgaaaacatggtaatctatacattacttgggtgctattattatatataactagctttggagtcagaattagcgtctcatcctggctctaccactttccaactgtgcgactgtggccaagtgactccccttctctgagcctcagttttcctcttctgtaaaatgggggtaaagggataagaactatagggggatctcaggggatggttaagagaaatccatgagataagcaaacacattatctagtttagtaaagctaagcaatgaagacttaacagccccatggtgaaggcttaatacatggtagctataatgattactattaatattgtgaaataaaaggttgtgatgaaccaaccatatcttctca

SEQ ID NO: 1230 - DNA, 335 bp, Homo sapiens
ttttttactatgttcctggaaagaaataggcagcatggttcacaaatctaaatttattcaatgtaaagggctatcatttattctaaaattatttacttcttactttgtgagggtgacacgccttttctttgtatgaaataattgttggtgatagattgtagtatgtttgtaaatataccttacctgttggaataaagtttggaaatactctattgaactctctaatttttattgaaatataataataaaaattgaaatgtaaaaaattaaaaggtcacttatcttagtgatctttaggctcctttcggtcctgagatgctgtaattctaggcact

SEQ ID NO: 1231 - DNA, 403 bp, Homo sapiens
gcacaaggtctggatggagagcatgagttacccagctggaactctgacataggttgacagcagcatcccccattcccaggtgctcatgtcttcccttcttgtgccttcccttgggcactaagtttggcacagtggctaggatgtagcattcctcactggggccatctgtcacatcaagaagggttcattgagtgcctctgggcaggacaccccccgcccactccctagaccatctccctgtctgtaccactgaggcaactggcttagctcagacaaggcaagcctgtttcttctctcttgctgccttgcatggactagcactggtgctgatagtgctggtctgaaaatgcagccagagtcctgagtgcttagtaatgtccttcctgagcgcaggctgggagtg

SEQ ID NO: 1232 - DNA, 593 bp, Homo sapiens
gtctaggcttccatttgcttctcatgaggtctatgatagctcagcgcctggtctctctgggtctacccaaaaagtagagggtttttagttgttgtttgtttgttttaaataggcctaaggtttcaggtctaaaattctgtggtctcgtgttgttgttgtccccattttctgagtgttaatctccatgaaacaagcacagatgttagaaatccagttgtgtttgctgtttgctagcaaagtctgtttcctgagatgatatttccaaaaccggatctcatctctttgaatccttggaggtttatgaataacgcatgttggtgatgatgctggcgtggcagccccaatgaatgtatgaaatttgatgtttcccacgaggaagaaggggagtggctgggattattgaaaggctctctggttctgggtttgaaggaagcatttagaattctgctagatccccttttgctacatccggatgattaattttacatcctaaatccttgctcgtgattgcttgcacccaggaattcaaggttacagtgagctatgatggcaccacttcattccagcctgggtgacagagtgagaccatgtct

SEQ ID NO: 1233 - DNA, 430 bp, Homo sapiens
aggaaacttcctagttagaaatctatgaatattaacttcttgtcttcactaaccagagttgttctcaactcataacacgtggtttggtaaaccatttgcaatgtaaacatagcagattttacttgtagtttcataatttaggcaggttggctctgtattatttctagaatcacaggtatctggatgaagaatcaccattttgtcattagagattacaacaaatgtagtttattctttttaccggtaatatcaatgtaagcaaaaattatactttttagctaagcatgttatcttcccagactggaggagttattatcttccatattttctctatcttccactatacaaagggaaaatagattggaattgtactggccattgctttgtaaagagaatataaatagcaataaaacataaagaaaatgactga

SEQ ID NO: 1234 - DNA, 299 bp, Homo sapiens
ctccatctctggctactcctccacttgtatcaaacttccaaatattagaatatccttgggtataatcctgtctgatcctctcttcctaagtgacttcctcttctcctgtagccttaattattgcaaatatttggaagatcctctaggccttcagcttagacctttctctggaacaccagactcaaacgtactgtaatgacctgtttgacattcatgtgggtgtcacatactgcttatccatccaaacagatttgttctatttcctttgctcagatgctcccccactgtctccttcatct

SEQ ID NO: 1235 - DNA, 340 bp, Homo sapiens
gttttttaagtcaataggattggttcataggatgccaagggctacattggttttaaaattcatctagaatacggccaggccagatggctcacatcggtaatcccagcactttgggaagctgaggtgggtggatcacttgaggtcaggagttcaagaccagcctggccaacatggtgaaaccccatctctattcaaaatacaaaaatcagctgggcgagttgacgtgtacctgtagtcccagttactcaggaggctgaggcaggagaattgcttgaacccgggaggcggtggttgcagtgagctgagattgcaccaccgcgctccagcatggcgacagaac

SEQ ID NO: 1236 - DNA, 401 bp, Homo sapiens
tggatattagtcctttgtcagatgtatagattgtgaaaatttgggttgtctgtttactctgctgactgttccttttgtcatgcaaaagctctttggtttaattaagtcccagctatttatctttgttttaatttgcttttgggttcttggtcacgaaatccttgcctaagccaatgtctaaaggaatttttccaattgtatcatctagaattttaatagtttcaggtcttagatttaagtctttaatccatcttgagttgatttttgtataagatgagagatgaggatccagtttcattctcctacatctggctagccaattatctcagcgctatttgttgaaaagggtgtccttttcccactttatgtttttgtttgctttgtcaaagatcagttgatca

SEQ ID NO: 1237 - DNA, 169 bp, Homo sapiens
ataagggaaagaaaagactccatgaggcagaacaggaaacttcttctaattcattctgtttccagcatgtgagacagtcagtgtgtcgtgggcaagacaatcaaattgaaatatggcccagctaaacacaagcgctgttcacatgggaaggtcaagaaatgcaacgaca

SEQ ID NO: 1238 - DNA, 392 bp, Homo sapiens
ccacgggcagcgtgatattcacctctgtggccccagtgcctaacatggaatctggcatgtgttaggcatttaaggaacattagaggcagggtgtggtggctcacacctgtaatctcagtactttgggaagtggaagtgagaggactgcttgaggccaggagttcgagatcagcctgggcaacaaagtgaaccctcatctctacaaaaaaattaaaaaaaaaattagctgggcacagtggctcacacctgactcagctattcaagtctcagctgttcaagagattgaggtgggaagatcacttgagcccaggagttcaaggctgtagtgagctataatcacgccactgcactttagcctgggtgacagagcaagaccttgtctcaatgtctca

SEQ ID NO: 1239 - DNA, 378 bp, Homo sapiens
gcataatgatcaaatcaaggtaatgttaaatgcttgaggcgatgtatatctccttatttttctaactggacttaaattctaaagagactatatataagttaaaaatgaagaataaataagagctcaattaaacgggaattttaaaagttacaataaatttgggataaaatgtaatgtaaggtgtttcatatggagagccatcactgccttttgatcactgtttccagaaaagcacagacttgtgcacctccctctgtgctttcttatgtttggacagttgaacataccaaaacaggtgatgagcaaacttgcaagcagtttttactgatagtttttacatagcataatgaagtataatgttataaataaagaactgta

SEQ ID NO: 1240 - DNA, 406 bp, Homo sapiens
aatgtgcaaccttggaagagctgatacaatgtatggtaagctgaagtacgtttccaacactgctgctcagagcatacagaagttttgcatcctggaacattgcttcccatgaaacaaagcacttcataaatattttatgtttttcttgagcaccctttcaaggtagggatcaaatagtgccagatcaattttcccaaaaggaaagaggaagtatccagagtttagactgaaggcttagagtcaaaactacaggaaggtcacactgttctctggaacactgttgctcttcagtttgtagagtttatgatggaaaaggcatcagtctgtcaaaagacttgtttaatcctgataatgactttggaattatctctcctgggtctcagttaataaactgaagaatgaccta

SEQ ID NO: 1241 - DNA, 480 bp, Homo sapiens
tcttctaatcatttcatttttcttgaattgttatattctctcccaacttttctttttttaacgacattgagctctcctcttcctgtcttccattagcacctttcctaacaaccttatttgttcttcaattgttatttatgcttgtcttctcagctaaattgtaaggcccttgtagtgaactcagggactgtgctttatattacttctgtatattacagaataggactatacgaatgcaggttgaatagatggaatcattttatatttacaattaagtaagaaaatgggaaacatagccatcaaagcagtcaaggaacaggtagggcacttaccctttctattctcccttgctaccttcttttttgttcttgttttgagacggggtctgggctctgtctgcagggttgggagtacagtgggtacaatctcgggcttcgctggcagcctcaacctccgggggcttcagggcattcctttcat

SEQ ID NO: 1242 - DNA, 436 bp, Homo sapiens
caaactgaagattccagcactgcacatagggatgtatttaatagttaatggaggaaacagaaaggcatcagagttttgttgttgttttgttgttgttgttgttttttaagagacaaggtcctgtggtgttgcccacactggaaacaaactctaaggctcaaacagtcctctccctcagccttccaagtagctgggactacaggcgagctcctgattttttaaaaatcagaactagttattttgaatgatctaccactggttctctagcaccatctgttattttgtatcttaacacagttcctgtattgtaagatgaatgaatcttgataagaattaatggtttatcttcttcaaaatgtaccagccaaagattcagaactatttaaatactatatacagttcatcatctggtagacaaagaagtagctcaaaaaaa

SEQ ID NO: 1243 - DNA, 360 bp, Homo sapiens
ttgcaaactgtctcactgtttttgaaacaagtttttgtttccagacttaattctcaggaaaccatactttaattccatgaagaaagttttaggccaggcacagtggttcacacctgtaatcccaacactttgggagcctgaggtgggacaatcacttgagaccagcctgaacaacatggcaagacccccctctctacagaaattttaaaaattagctgggcattgtgctctacacctggggtcccagctactgaggaggctaaggcgggatgattgcttgagcccaggaagatgcagtgagccatgttcacactgctgtactccagccagcctggcttatagagtgagaccctgtcttaa

SEQ ID NO: 1244 - DNA, 303 bp, Homo sapiens
tactgtgagtgccccaaacgcggaagtgggaaagggagaccctcctctcccgaacacacacacccactggagaaactgaagatgtgtttgcagaagttcccgagtttacctggagctgagtcaagttagagagctcagccgagcgaaatacaagggtagaggaagtagcagaaaggcactgggagcttgctggatccctaagcagcccattcttgcctggcaccacagggatccatcaggagaatggccagaggagcagggggaaaactccacagagagaaggacttctctagcagaagtttg

SEQ ID NO: 1245 - DNA, 441 bp, Homo sapiens
ctgtcagttgatagacatttaggttgtttccatttgttggctgttacgactaatgtgacatttgtgcgtatgttttagtgtattggtatgttcttatttcttttgggtttatacttgagtgagattgctgggtcatgcggtaactatctgacaaatgttaggtaactgtttaaccttaagctttgttttccaaagtagccacaccacttagtactcctatttgcagtgtcacagggttccaattcctccatgtctttgctgacatttgttatctgtctttttgattattgccagcctagtaggtgtaaagtggtatctcattttggttttgatttacaattccctgatggccagtagtgttgagcatctttcatgtactccttggccatttgtatatatcttctttggaaaaatgtctattaaagtccttgctcctatttt

SEQ ID NO: 1246 - DNA, 605 bp, Homo sapiens
aaaggtaaggaaatagcttctaactaagcaaagttgctcaaagtggcacatagagtgaggtctgcggctgttctcttactccaaatgtggggtatctcagaaattgccatcctccagaaggctacagtctagctcagactgtgcaaattgttctccatttgccatgcccccatgcactcaacactattccatgtcttccgtgtgctctgggaagctgacccttgtcatttgcatgactgggactctctgctctctgtgtttgtcttggggtggggcctatggaaggctttagcaggatattgggagggcagggaagagaaagaagtcagggtatttcttcttcatgtcctacttcggccctgtgcgctggccgtgatcatgtcctttcaggatataactcccttcgccctgttctcctctgtacctcttctgatgcagggcttctaaggaaacactgctccttttccttgactgtttatccctaggggtagtattatattctcaccattgctatcctttgggtgccctgccaccttgtttgctccttaagtctgtctacaattaatgcaaataactcctttattaaaatctctttatttgaacac

SEQ ID NO: 1247 - DNA, 304 bp, Homo sapiens
ttttatattattaccacatagcacacttgagaaagcctcagggatgcgaaacaccttgcctgaagtgacatactttgtaaacgggagggcaggactccaagggaggccctctggctcagctctcctgccccttgctatgctgaactctgttggattacctctgcgagtctcacacgtatggtttcacagcccccttttcataaaaatacttggcaaacctcttgactttcttgaaatgaaattaataaattatacaatttatctaaacacctaatttccaataaaatacatatattaaaaaaaa

SEQ ID NO: 1248 - DNA, 458 bp, Homo sapiens
tgggaggctgagctggggggatcatccatgcccagaggtcaaggctgctgtgagctgagcagtgatcgtaccactgcactccagcctgggtaacggagtgcgactctgtctcaaaaataaataagtaaataataaagaagcagttgcatacatagtggtgagtacgcagaaagtgaaaactgagaaaaaaccattttcagagcaagcactgcacgtgaaaggagtatggtgtcataacagaatcacaagtcatagctggagaatttacaatattgtatgtgcgagtgtatatttaatggaatactggaggcccgtgagcaaagaatatgataggatcgaatcagtagaaaaacatctcttgtcctcagagaaattccagataatgttagatatgtctaaggaaaatcaggatgtggtcaatgatcaggaacaatagtcatttacatttggatatgatg

SEQ ID NO: 1249 - DNA, 428 bp, Homo sapiens
agtgcagtcgtatgatcttggctcactgcaacctccatctcccaggttcaagcgattctcctgccccagccacctgagtagagtagatgggactacaggcatgcaccaccatgcctggctaatttttgtattttttgtagaaaccggggtctcaccatgttgcccaggctggtctcgaactcctgggttcaagcaatcctcccacctcaacctcccacagtgctagaattacagttgtgagccaccataccccagccttcatgtgtttatttctgacttgcttctattgacaggcagtagagttcagtggtgtaagctcagtctgcttaggtttgaatctgagctctactacttacttagctgtgtgatcttgggcaagttacttaacttctctggcctcagtttcctcacctgtaaaacggggacaa

SEQ ID NO: 1250 - DNA, 440 bp, Homo sapiens
cttctcttctttataaatcatcacattcactcatgtaaaaggggccatgcctagttaagggaatccttacaatctggtaatgaaattatagaggaaggtgtcaccctcaaatgcaatgaaatttaatttgaaaattacattttcagaactgcaaactggagactctttcctcaaatctatatcaaaagcattaattatgaaaagcgtcatatgttctaaaatttttacttttttaaaaaagataatgtaatgagcttcataaacatttataaacatttatttaatacaaagaattatactttattttgagaatctggcttttctatcatttgtaatgaaacaaaaattcatgatagtggatggtagctatacttcagcaaaacaaatgtcaactcaatgttgatgttttctccagcattccccctcaaaccaaaaaaaaa

SEQ ID NO: 1251 - DNA, 274 bp, Homo sapiens
aaatggaatgcacattacaaaagaaatagctccctggtgggtggtttatgctccctgtttgaattttttccttcatattacagtttaaccacacccttagcatcgcagcttgactctgcccaaaaaagtcataaatgcatacaaggtcttcacaatttttaaaaaatacgcattgtactgaattctcatttaattcactactacgttgttgattgaggtggaaactcaatcaactgtttttactgccaatgaaataaaagtagctaatatttat

SEQ ID NO: 1252 - DNA, 506 bp, Homo sapiens
cttaagtactctaatgaaaatgacagtgtgctctggaggcagaaatgcaccttcctttttgcatgaaagatttacgctatggggccgggcacagtggctcatgcctgtaatcccaaagtgctggaattacaagcgtgagccactgctcccggcccaagtatttcttttttaggggagaaaaaattattggagaaaatttctttcctactcatttcccaaatttttctaggaagtctatgtcagatttcctttcttttttcttttctcccttaaaataatttttaattgttattataaacaggatggacctgtgctgaggagtgtagcaggactgtggttttattcctgcactgtctactgggttgtgtgaagatgggctagaaagaggatctgttgggaaggaagagtctaaaaatgaatgaacgtcaagagtcaacgactcttacagcatcattaccgtctgttcctcttctcagagagtcaggcatgagggccaccaggcaggg

SEQ ID NO: 1253 - DNA, 314 bp, Homo sapiens
acacgttggatgaagatgatatcttcagtttgggattcattggactggagcttctatagacacacccaagtggagatgctggatatgtggatctggatggaaggcaagagagttccagattggggattaagagtcatccaccgccgggcatggtgacttatgcctgtaatcccagcacattaggaggcccaagtgggtgaatcgcttaagccaaggagttcaagaccagcctgggcaacatggcaaaaccccatctctacaaaaataaaagataaataaattcgctaggcatggtgtcatgtgcctgtagtgcc

SEQ ID NO: 1254 - DNA, 398 bp, Homo sapiens
aaactgtaaatgcaagataaatagaagaaaggaaacaaaactttgaagaatacaaataaatgaaagagaaaaagatatgagaaatcaacaaaactaaaagctgtttattttaagactaataaaatgggcttaactctggtaagattgaatgaaaaagaaaagaaatgagtgaaaggtaattagaagtgaaatgaggagtgtaattagtaatacgagaaaatttaggaaatgagaccattatttacaattgtatgcccataaatttgaagacttggatgaagtgcatagtttactagaataacttgccatgaatggtttatgaccattaaagatgttaatccaagacggtagttcatgatcagaggtgattttgcaccccctcccttccctggagacat

SEQ ID NO: 1255 - DNA, 416 bp, Homo sapiens
aaacaatcaaattaaacacaaaaaaccaatgaacatgattaaagccaaaagcatattctagaattatgatttttagtaaaatcattgtatacaaggtatcactgaaaaccaactatttctatctaccagctacaaacagaaaatagaatttactttataaaaggctatttacagtggcagcagaaaatatcaaattccagaatttgatattttcaaattctaggaataatttggcaaaatatgggcaagactttacactgaaaactataagttgtgttgaaagaaattgaagaagaattttttaaatgatggtatatatactattcatgtattagatgactcagtattataagggggttgattcttctgaaattgatctgtagatttgatgtaattccaataaaaattctaacttt

SEQ ID NO: 1256 - DNA, 114 bp, Homo sapiens
gtctgcttctttataactgaggtctttcacaagacttggctcaataagtacgcattaagccagtgaataatattctatcctatctcgtgatgtctagtctactgtgtgaaattt

SEQ ID NO: 1257 - DNA, 554 bp, Homo sapiens
tacatgcatatcaaaaagtatgtgtacatagatacatagatataaagtgtatgtatttttatgctaaattcgctttgactatatcctactatatgcttctaccagtagtgaaagagatttttcatgtttctgagctttttactatctggatacctttttagtatttttataatatattttaccaacagatgttcctcattctgtgcgtctttacacattttttttctttcagtctttttctagtattcattctgctttattcttctaggtagttttttttactgaatctaaagtgtttcccaggcccttagcataataaactactctaaatgagaaaaaaaatggcaatatttgccttaacatcttacatgtatacctgaatttggcaagaattgatgtcatcacaacaatgagaatgtcatctaagaacatgatttttttattaggtaaaatgagtatttttaatttcatccatatattcctagttttaatactctttctgtattcattatcaaatgcctagatgtataattagactagagtcagacagctaa

SEQ ID NO: 1258 - DNA, 443 bp, Homo sapiens
tgtaaccatttcccgtctgcaccgagaggccacggtgtggagggggagctcctgcccacggcacttggaaggtgctggggcagaacccagctccagcgctgatgtgtggcagcatctctggaaacttccatttcctgctctgtctgaggaggcggggccctgctgatgtctctgtgtcttggagctcaggacagtcaaatctgcaccacggctgcctcccctcttgccgtgtgaacgtggcaggacgtccactccaccccacttcctgcatggacatggctccatggctgtgccctacctcccttcctgcatgaatgcagcaccacggctgcaccccccacttctgtggttgtggcatgatggctgcacccccacttcccatttgaatgcggcaccgcagttgcgcctccctgccacttcccctgtggacgcggcatgatggc

SEQ ID NO: 1259 - DNA, 422 bp, Homo sapiens
gatttcttgaggccttttttatctgtcaatatttgagcatttttagtgactcaagttctaaatttggacctttttaatgtctagtttgttaaaagtgaaaaatattgactctcaaagttcagacattagattaagaaataaaaatacatttagataaccccacttcctctgatgtatacgaataaggatactgtatgtctggatgaagtagcgatacggcatactgaaaaagcccagaggaaagagagagaccctgtaagttacacgaaagagccccagaacatccttgggaaagtctgtctttttttttttttttgagacggagtcttgctctgttgcccaggctggagtgcggtggcaggatctcagctcactgcaacctccgtctcccgggttcaagtgattctcctgcttcagcctcc

SEQ ID NO: 1260 - DNA, 717 bp, Homo sapiens
aatcatgtctgattggtacatacactccaggaagtctcaacctagaaacatttccaacctaagcatttaaaggaaaactggctcattcttctgacccaaactcaaaaaatatgagtacttgcgtacctccatttctgcatgaagattttaaaacagatttcatttttttctgtttattttgggaaggtgccgtgggggtgttctttcaagtgattcacatctcaaacccataccactctcaacttttatttgatgtgttcaaagccaaaaaataaaataaaataaagcagggctgaacacttaatttgacatgaagctgaaggactgagcaagccagaggagagaggttgaatgaagcatagccttggcttcataccacactttttgtgccttgtattatcaatgtaaattctgaatgttgtacagtaaacttggatggacttcttagaaaaggctgcactggcttctttttcagcacatgtacatatctataaatatatatacatatatatttggtaatgccaaacagctctgttatattgtattgaacaaaatggacggtttggatgttttatgtcgagtttgcaaaaaaaaaaaaaaaaaaaaaaactggatggttgcagacttttcaagataaatgtacagacgtaaattactgcatatcagttatttatgaataaagagtcttttattgacattttaggatactacatgagt

SEQ ID NO: 1261 - DNA, 447 bp, Homo sapiens
aatcatgtctgattggtacatacactccaggaagtctcaacctagaaacatttccaacctaagcatttaaaggaaaactggctcattcttctgacccaaactcaaaaaatatgagtacttgcgtacctccatttctgcatgaagattttaaaacagatttcatttttttctgtttattttgggaaggtgccgtgggggtgttctttcaagtgattcacatctcaaacccataccactctcaacttttatttgatgtgttcaaagccaaaaaataaaataaaataaagcagggctgaacacttaatttgacatgaagctgaaggactgagcaagccagaggagagaggttgaatgaagcatagccttggcttcataccacactttttgtgccttgtattatcaatgtaaattctgaatgttgtacagtaaacttggatggacttctta

SEQ ID NO: 1262 - DNA, 365 bp, Homo sapiens
cactgggccagacctagtgatgtggggcattatctgtaaatgcacctgaaaaattagataaggctgtgaaaatggaattttagtgatccagggtttgagaaaagtcctcttggctggagtaaggcatgtacgtaggtcatatgattgtttctgaaacatgaaactcagaacccaaaaagttcagcacattttggccccagtaagtagaaaacaccccggacattatctatggatgaaatagtgtgctgcagaggacagtccctggccggaagctggaccattccagtgaattcagcaaaaccagagaactctaccccgtgttttgacagatttaagagaaaatgcagtaaaattcagcttttagg

SEQ ID NO: 1263 - DNA, 327 bp, Homo sapiens
aagactactctttataaattagaaccatcaatttgccctacctttaaattacctgaaagctctcgtaagggtagtagcttttccatgacaagctttaacgctttccataaggtcgtaatgccttacgttttagaaagtgaaagcactctatcattagttactaggtcctttctccttggtcttactcttagttatcgagtagccaaaatgtatgaaggatgttcagtcaaaatagacagcattctccttgaaacctaagagtgttgatcttaatcactttgaaccttcatttctctaaaaccctacttggcatcacatatttaaaaa

SEQ ID NO: 1264 - DNA, 887 bp, Homo sapiens
ggctgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaaggaagtcactgctgcccgagaagctctggctacctgaaacacaggctggctcatgtgcccacgcttgtggcaagttccaaccaagtgtgtgggtgcggtgagccatggttgggtgagctgtgggatgacccagagatattcagagctcagaaaagccgtggtacacggacgcagacagagggaaacggctggggctggaacaagagtcaaacgggggtccccggggccggcacggacggcgaacgcgcggacaaccggggggaacggggcagaaccgacccgacaaaccggtccgaggtccaaagcacggcgggaaggcccgcggagagtgg

SEQ ID NO: 1265 - DNA, 638 bp, Homo sapiens
ggctgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccatctctaacgaagtgccggagcacccatgtgtatcccctgtctctaatcatgtttatgagcggcggctcatcgagaagtacattgcggagaatggtaccgaccccatcaacaaccagcctctctccgaggagcagctcatcgacatcaaagttgctcacccaatccggcccaagcctccctcagccaccagcatcccggccattctgaaagctttgcaggatgagtgggatgcagtcatgctgcacagcttcactctgcgccagcagctgcagacaacccgccaagagctgtcacacgctctgtaccagcacgatgccgcctgccgtgtcattgcccgtctcaccaagggaactgtgaaggggatgggcaggagggcttgtgcagggttttgtaagcagtgatctagtttcattaaaaaaagaaaacaat

SEQ ID NO: 1266 - DNA, 456 bp, Homo sapiens
cagtatgacctcattaaatatacatatattaatataatccccatcttagtgcatgtatataaaaatcagataagtacccagtgcttaacactggtcaccattgacattatctgcaggtgttaggatcctggggggtttcactctcctgcatttgctattttttttgcaatgtttaactttttaaccagaagcatatgttatttaagcagaaaatattatggaaatactttttcaataaatactttttcaattaaaaactaaaatgaaatcatgtgtcccaaacccaccagggatcacatatgaaattaagaacttcattgagtcaggaattgagactgaaaatattgagacacaacaattaaggaaggttaagaatagagagcagaagttgccctgagccctgcatgtggctccaccaaagtcagaggaagctgctccaggctggggattcccaga

SEQ ID NO: 1267 - DNA, 428 bp, Homo sapiens
atgctgccctggtagggtggttgtggtggcaatggggtgagctcctctagcaccacgatttcatcttgcagagcaacagagaggccttggcagtgtctgaaagggcaagtgtgatttggaagtggtaatcacagtgagtcagactacagggaattcctaggtcttagcactgaaaggcaagtcttgcagcccccaggaacatcaagtggtgggtgctgttcccctgacccctgagactgggtgagttccctttgctgggtagtgtgttgatataggtccctgtgtgtcccctgttgcatcagtatttacagtagtgtgttaattgctggtttaattatctgtcttcccttctatattgtaagccccatgaagacagggactgggtctggctcagatctgtaaccacagtgaccagcagagtgcctggc

SEQ ID NO: 1268 - DNA, 232 bp, Homo sapiens
tgcacactcttaaaacttagaggtgtttagtctggtttgcaagctttcctggctttgctaatgctccccataaattacctaagatgctctcaatgtttaggtagattcattttttctcctagaaaaatgcaaagtacagaagtatgttctcctactttccaaatatgatttgctcagccatgtacttctcaatatcctagggaaagctcaaacacttcctctcaccctaggg

SEQ ID NO: 1269 - DNA, 271 bp, Homo sapiens
tttgagttactcatcacacacactgtttgtgttgcagtgtatgagagggcagcatatgatcctgaatgaggacactattctggctttatttattgacatatttccattgtcttctgttttaaaagatggttctatttattgttcaacttaataaaaaacattgttttggttagggaggatagatttttctgttgctgtaatggagccttgctgactgttaagagtctgaaaggcagaactgtgtagacccttattgagtccagccttccca

SEQ ID NO: 1270 - DNA, 351 bp, Homo sapiens
ttcccctctcccatccactttgctggatgcaccccctcttcaagccactctcccctaggcctaaaaaggatccctgctgcattagtgcatcttcagtgccggtgctcagtttggtttctgaggaattaatacagaacaggctcagctctagggaggcctctgggaaagaggctggaaagaggaatggagaataactggttcttactggtgacttacaactcttagctatttacttatttatttagagactgggttatgaggctggctaatttttgtatttttggtagagacggggttttgtcatgttgcccacgctggttttgaactcctgggctcaggtgatccacctgc

SEQ ID NO: 1271 - DNA, 235 bp, Homo sapiens
gatattttaatttgcctataaagtaaaaaagcttaccatttaattcatttattaaatgagcatttattaaatgcaaacctggtattttaaatttcaggatttctatgaccttaagcagcaaatatttctagtacttccaactctccataaggagacactttttaaagtctatcctaaactctccccaatagaatcttgcataccatccccaactctgccctccaccccaacactg

SEQ ID NO: 1272 - DNA, 571 bp, Homo sapiens
ttttttttttttgctaactaattttttgctaacaatttgctaatcaaattgtctgcttgattctgaaaaaaaaaaccctatcaaaatattatgttttaaaacttatttctttatatttgaatcacatgaatctagtttaagatggaaacccactgctgctttgcctactattcccccaagaagaaaacaaaaggataactgagaagctatcacagttagtattcctagaatctagagtcatatttgcagaatgtaatgctgtttactttaactctgttttggagcccagagctcaccctggtgagtgtggatgaactctgggcacgtcatttcaaactgacagagctttgtgtacataactcagttccacatttattcctggtattctctccctgtaatcaattcctctgtgagggatttcagggtgagtagtgttatcagaaaaaaagaaaaagttgttcaaaacaacaacaaaaaaaaggaaaaccccaaatatattttagaatatatggaagggcaaaccaatattgattatttgattttgggttatggatcattcttccccggaccc

SEQ ID NO: 1273 - DNA, 1735 bp, Homo sapiens
gagtgctcagtagaaaatgggtagccttatgtatctaccctaaaggaaaaaaaaaaaaaaaaagacttgattctcaccacagagctgctttcttatacataagaaattgcttgtagtattcatgaacgacacagccaaacagcaggccggttgtagcccacttcgcctgctcacagcccatctgggcccgcctctgcacacccgggataccccagcttctttccctcaagctgttcatatattgagtcctcccactgtcccacagcagccacttgagggcagggctgagtcttggtcacccgtgtccctagtgcctcgagcagtgcccgacacagacatacagcagaagaaacaaactaaatgagtgagcggtaggagtgctttgaagccaaggggctgagcaatctgtgttggaaaagtgtgagatttttcaagttcagaaactccaccaattttagggtgaccgttggaactcctgaagttttagcgctcagaacatggggacccaaactcgaggagaccccaacctcctctcctggaggcaggggctgctccagggcaagtttccagaagcttccctaccctgtcgagttgccaggccggagtgtgattcaggaggggagaagcagtggctgtcagaagaggctgaaaacctctgcagcctcttgcctgggacacctctaggatcccacacggtggagaggggctgcaacaccccctccaggcaggaggggcttctgtactgtccaggaagggagtgccggtcaggaggctgggatcttagcattcacactttgctcccaggcccagtgtgggacttggcacaggctccttctccctcagatgcctctgattccgaggaaagcaatttcctgcctctgagcctccaggactggagagcctggaaatacagcgaaggctgtggagtggatagatccttcagacaaggcactcgttaaaagctgtctatttggagaatgctggaaaaaccatgatattgttccctaagactattagtgagtgcggctaagtccccagccccctctcctcccagcctctgcctgtcccacagatagaaatggggcaggccctctgataaggaagcttgtcccttgaattgttcttttctcaggagattcacccttttcctttgtttcttgctctgttcacaaaagcaaagcatctgaaatgcaggccagagataaagtgcagcctgatgcaattagctgagcgcagcccacaggtcctaatgggatacggctcccgttcctccagcaggcccttacataggcgctgtgtgtcgtctgcactatgcgtcaaagccccaagtgttgcccagcctccgcatccacaccccctttctgtccctggcacagaacccaggagagccactctggtcagaggggctcagcagcaggccctgtctcccaccagctgggttcctgggtcaagtttcatcagaagtcaccgtgaggaccatggtcctcacctgagaggcctgcagatgccctggaggctcctgtgtgcttctgtgactgttcctggcaggcatctgtatccacccctcatcccacacctggttggggtctggctgtgctcctgggagctgtgctgactcttcccggggccacctctactgacacccacacctgtgcatatcccaggtatcctatcccaaccttgccagcatgtatccaggattttttttttcctattacatataatggccatagta

SEQ ID NO: 1274 - DNA, 349 bp, Homo sapiens
tttcaaaaaagcacaaaggagataaatatatcaagatttttttttttagaatagcaatatgataaatttgggcgtgtatgcttgaaatctgaaatctagaagtatcaagtctggggtgcttatattaataaaaataaaattctattgagatcggtaattttaaaacattttcccactttgcttttaagggtacttcatgaattgtaattttttcttgtggaattaggttgtaattcctcagtttttctcccaattaacacaagttttgacatcgatttccatcagggcaaatacagttcaattcaatgagacccttcgctcctcccctccattagaacttgtacaagtg

SEQ ID NO: 1275 - DNA, 723 bp, Homo sapiens
ctctttccctgctttcgggatctccagtgtttattgttttcatctttgtgttcatatgtacccaatgtttagctcccacttataaatgagaacatgctctattttattttctgtttctgtgttagtttgcttaggatagtggcctcaagctgcatccgtgttgctgcaaaggacgtaattttgttctttgttatagctacgatgaccgaatttcttgtttgatttatgggtagatattaagtggtggtattctggagctggttcatatgggctgatttttagcatcttttcccagcttcctatgatttcatgttatagtttgaaattggttgtggtggaaatatttacaccagggaaatcggtaaatatcacaaataatggctcttttgtccagtgattgttagacatttaccagcacaccactggcttttagtgaataatcttttgctttgaatggagtctacacagtcattgactttcctgtaatttccaattcctattaatttcatattctagaaaatccaagtatggcactatataacagcaaataacttctaaagtaatgacagtttcttcaatactactgaagtgatttttagagaaaaaatgggatgatttgaggaaggagaaagaaatgtaaactggaaaaaagcaaataaagtctttatttcaaattttgatcctaaattttttctatgatgtccttgcccctcccgtatttcc

SEQ ID NO: 1276 - DNA, 1077 bp, Homo sapiens
gctgtttcacttacaattctcctttcatatgacaatatcatatggattcagttattggtggccttataatatggtcaggagagcttttccgcttcccaagcccctgcccactgttctttttactgcctttgttggctatcctcagcatttgaagtttgtaataatttaatccaattaggagttaaaattacattaaatttacatattaatttggggaagtttgacccacaatactgtcttcccatctgagaacatcatatcattttctgtttggatcttatttatatctttagtaagatttgagagtttaagttctttgcctttaaaaaatttttaatatgttcttattttggtcactattgtgaccattttcatttataagagcttattacaaataaagagaggagccaggtgcatggctcatgcctgtaatcccagcacattgggaggctgaggtaggaggattgcttgagcccaggagttccagaccagcctgggcaaaatagcaaaaccccatctcttaaaaaaaaaaaaaaaaatttaagaaaatacattttaaaatacacagagaaaatctgtttttgtatgcttatatacaacaaacattgtaaatgcttactaaatctcatgaattatagcaggttttcactagagtctcgagatgtttagaaatacaattgggacattcacaaaaataatttgatcttgtctttttcaatgtttgactgattctttttttgaaatttttgttgtctagaaactccaatgtggtgttgagttataatggtaaaagtaggcctccctgtctattattaactttagtggaaatggttttggtatttagttatttagagtattttacttgttatttggtaaataatctctattttatttaaataggttctttcctgtttttccaggtttaaagaatggctgctgaatttcatcaaatgccttcttagcatcttttgatgtgatcatgagttactcttctttaagctgttgactaaccaattgtgtgtatgaagttgacattaaaacatgcttgcctccttgaaataaaccctatttggtcat

SEQ ID NO: 1277 - DNA, 378 bp, Homo sapiens
aaactctcaaggatttcagtttgcctctgcacttcatatcctatttatgaaacagctttgccaaatttaagtaccttaaaaataaccctattaacagatttttctctggaccaatcaatcacagacttcattccctcatgaaataaagagcagtaccaaggttatagttttccttttatgcctgttactatgtacttctagttaagtgggtaaaggcccaggtctcaggagtgagctctctgaatatattattattttatcaaaaactttttaacacatctgcccttggaccgatacctgtttttcctcccagaaagaaggataatcgttgattaaaggccatttttgataagaaggactgaagggtgtccccaaaga

SEQ ID NO: 1278 - DNA, 356 bp, Homo sapiens
gatacagagttttatttaggagtgatggaaatgttttggaactacagctagtggttgcatgacattgtgaatgtacaaaatgccaccgagcagtttactttaaaatggttaatttgctgagtatgttggctcaggcctgtaatcctagcaactcgagaggctgagacagaaggagagcttgaagccaggagtttgaggccagcctgggcaacatttcaagaccacagataggcatggtggtatacacctgcagccccagctacttgtgagactgagaggggaggattgcttgagcctagtagttcgaggtcacagtgagctatgatcatgccactgcactccagcctgggtgacag

SEQ ID NO: 1279 - DNA, 4045 bp, Homo sapiens
tctggtttgtaacttatgcctaagggacctgctcccattttctttcctagtggaacaaaggtattgaagccacaggttgctgaggcaaagcacttattgattagattcccatcaatattcagctgccgctgagaagattagacttggactctcaggtctgggtagcccaactcctccctctccttgctcctcctcctgcaatgcataactaggcctaggcagagctgcgaataaacaggcaggagctagtcaggtgcatgtgccacactcacacaagacctggaattgacaggactcccaactagtacaatgacagaagataaggtcactgggaccctggttttcactgtcatcactgctgtgctgggttccttccagtttggatatgacattggtgtgatcaatgcacctcaacaggtaataatatctcactatagacatgttttgggtgttccactggatgaccgaaaagctatcaacaactatgttatcaacagtacagatgaactgcccacaatctcatactcaatgaacccaaaaccaaccccttgggctgaggaagagactgtggcagctgctcaactaatcaccatgctctggtccctgtctgtatccagctttgcagttggtggaatgactgcatcattctttggtgggtggcttggggacacacttggaagaatcaaagccatgttagtagcaaacattctgtcattagttggagctctcttgatggggttttcaaaattgggaccatctcatatacttataattgctggaagaagcatatcaggactatattgtgggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttcagtgtgatttgtttttcatttgggccaatttgggataaactattttcacttgggatttcaggatacagtcaaaataagcttaaataactcaggacatctttgtgctaaactgtgaactctggacaaaaatagagagtctctgaatagggcaggagcaggaaaatggctcctgggtggctcttgtatgcttcttcaggatgctgatggcctttgggaagcccagtgtaaacaatgataaaggagcttaacacttttataggtgatacatgtgatttaatcaaatcactattcctgatctcatttactaacagaataaagtggtaaatatttaaattaaaaattccaaagaccacttttaagtgcttcttcactattttgactggcccacaaacaccagaaattcagaccctgaagttttctgcctcagagaaatttaagtaccttataatgttccccttctacaacttttttcttgcagagatacatgtgagttgacaagaaacattaaagggaaataagaagaagctgataaagctttataggaggaccaaagaactagcttactataataaaaaaattttaagtcttcaagggtatacatcataa

SEQ ID NO: 1280 - DNA, 709 bp, Homo sapiens
tctggtttgtaacttatgcctaagggacctgctcccattttctttcctagtggaacaaaggtattgaagccacaggttgctgaggcaaagcacttattgattagattcccatcaatattcagctgccgctgagaagattagacttggactctcaggtctgggtagcccaactcctccctctccttgctcctcctcctgcaatgcataactaggcctaggcagagctgcgaataaacaggcaggagctagtcaggtgcatgtgccacactcacacaagacctggaattgacaggactcccaactagtacaatgacagaagataaggtcactgggaccctggttttcactgtcatcactgctgtgctgggttccttccagtttggatatgacattggtgtgatcaatgcacctcaacaggcaagtgaaatatgtagaagttctctttttggcaagttctgtcagtgatagatatcatatgttcctcatacacagagataaagggtgtccacgtgggagacacaaggccatcctggcctgtcaggtacgatgtgcactgttccaaagctgataacttggccttgactccctaattaacaatcacgggggaaaaaaaaggaggcaataaataattcttaatctctgactctgctgtttgctgagctcacagaaaactccaggcagaatatcatgtgctgaaggatactttaga

SEQ ID NO: 1281 - DNA, 3657 bp, Homo sapiens
tctggtttgtaacttatgcctaagggacctgctcccattttctttcctagtggaacaaaggtattgaagccacaggttgctgaggcaaagcacttattgattagattcccatcaatattcagctgccgctgagaagattagacttggactctcaggtctgggtagcccaactcctccctctccttgctcctcctcctgcaatgcataactaggcctaggcagagctgcgaataaacaggcaggagctagtcaggtgcatgtgccacactcacacaagacctggaattgacaggactcccaactagtacaatgacagaagataaggtcactgggaccctggttttcactgtcatcactgctgtgctgggttccttccagtttggatatgacattggtgtgatcaatgcacctcaacagggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttcagtgtgatttgtttttcatttgggccaatttgggataaactattttcacttgggatttcaggatacagtcaaaataagcttaaataactcaggacatctttgtgctaaactgtgaactctggacaaaaatagagagtctctgaatagggcaggagcaggaaaatggctcctgggtggctcttgtatgcttcttcaggatgctgatggcctttgggaagcccagtgtaaacaatgataaaggagcttaacacttttataggtgatacatgtgatttaatcaaatcactattcctgatctcatttactaacagaataaagtggtaaatatttaaattaaaaattccaaagaccacttttaagtgcttcttcactattttgactggcccacaaacaccagaaattcagaccctgaagttttctgcctcagagaaatttaagtaccttataatgttccccttctacaacttttttcttgcagagatacatgtgagttgacaagaaacattaaagggaaataagaagaagctgataaagctttataggaggaccaaagaactagcttactataataaaaaaattttaagtcttcaagggtatacatcataa

SEQ ID NO: 1282 - DNA, 3635 bp, Homo sapiens
tctggtttgtaacttatgcctaagggacctgctcccattttctttcctagtggaacaaaggtattgaagccacaggttgctgaggcaaagcacttattgattagattcccatcaatattcagctgccgctgagaagattagacttggactctcaggtctgggtagcccaactcctccctctccttgctcctcctcctgcaatgcataactaggcctaggcagagctgcgaataaacaggcaggagctagtcaggtgcatgtgccacactcacacaagacctggaattgacaggactcccaactagtacaatgacagaagataaggtcactgggaccctggttttcactgtcatcactgctgtgctgggttccttccagtttggatatgacattggtgtgatcaatgcacctcaacaggtaataatatctcactatagacatgttttgggtgttccactggatgaccgaaaagctatcaacaactatgttatcaacagtacagatgaactgcccacaatctcatactcaatgaacccaaaaccaaccccttgggctgaggaagagactgtggcagctgctcaactaatcaccatgctctggtccctgtctgtatccagctttgcagttggtggaatgactgcatcattctttggtgggtggcttggggacacacttggaagaatcaaagccatgttagtagcaaacattctgtcattagttggagctctcttgatggggttttcaaaattgggaccatctcatatacttataattgctggaagaagcatatcaggactatattgtgggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcgtaagtttaagaacacccagtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttcagtgtgatttgtttttcatttgggccaatttgggataaactattttcacttgggatttcaggatacagtcaaaataagcttaaataactcaggacatctttgtgctaaactgtgaactctggacaaaaatagagagtctctgaatagggcaggagcaggaaaatggctcctgggtggctcttgtatgcttcttcaggatgctgatggcctttgggaagcccagtgtaaacaatgataaaggagcttaacacttttataggtgatacatgtgatttaatcaaatcactattcctgatctcatttactaacagaataaagtggtaaatatttaaattaaaaattccaaagaccacttttaagtgcttcttcactattttgactggcccacaaacaccagaaattcagaccctgaagttttctgcctcagagaaatttaagtaccttataatgttccccttctacaacttttttcttgcagagatacatgtgagttgacaagaaacattaaagggaaataagaagaagctgataaagctttataggaggaccaaagaactagcttactataataaaaaaattttaagtcttcaagggtatacatcataa

SEQ ID NO: 1283 - DNA, 3870 bp, Homo sapiens
tctggtttgtaacttatgcctaagggacctgctcccattttctttcctagtggaacaaaggtattgaagccacaggttgctgaggcaaagcacttattgattagattcccatcaatattcagctgccgctgagaagattagacttggactctcaggtctgggtagcccaactcctccctctccttgctcctcctcctgcaatgcataactaggcctaggcagagctgcgaataaacaggcaggagctagtcaggtgcatgtgccacactcacacaagacctggaattgacaggactcccaactagtacaatgacagaagataaggtcactgggaccctggttttcactgtcatcactgctgtgctgggttccttccagtttggatatgacattggtgtgatcaatgcacctcaacaggtaataatatctcactatagacatgttttgggtgttccactggatgaccgaaaagctatcaacaactatgttatcaacagtacagatgaactgcccacaatctcatactcaatgaacccaaaaccaaccccttgggctgaggaagagactgtggcagctgctcaactaatcaccatgctctggtccctgtctgtatccagctttgcagttggtggaatgactgcatcattctttggtgggtggcttggggacacacttggaagaatcaaagccatgttagtagcaaacattctgtcattagttggagctctcttgatggggttttcaaaattgggaccatctcatatacttataattgctggaagaagcatatcaggactatattgtgggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaattatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttcagtgtgatttgtttttcatttgggccaatttgggataaactattttcacttgggatttcaggatacagtcaaaataagcttaaataactcaggacatctttgtgctaaactgtgaactctggacaaaaatagagagtctctgaatagggcaggagcaggaaaatggctcctgggtggctcttgtatgcttcttcaggatgctgatggcctttgggaagcccagtgtaaacaatgataaaggagcttaacacttttataggtgatacatgtgatttaatcaaatcactattcctgatctcatttactaacagaataaagtggtaaatatttaaattaaaaattccaaagaccacttttaagtgcttcttcactattttgactggcccacaaacaccagaaattcagaccctgaagttttctgcctcagagaaatttaagtaccttataatgttccccttctacaacttttttcttgcagagatacatgtgagttgacaagaaacattaaagggaaataagaagaagctgataaagctttataggaggaccaaagaactagcttactataataaaaaaattttaagtcttcaagggtatacatcataa

SEQ ID NO: 1284 - DNA, 3920 bp, Homo sapiens
tctggtttgtaacttatgcctaagggacctgctcccattttctttcctagtggaacaaaggtattgaagccacaggttgctgaggcaaagcacttattgattagattcccatcaatattcagctgccgctgagaagattagacttggactctcaggtctgggtagcccaactcctccctctccttgctcctcctcctgcaatgcataactaggcctaggcagagctgcgaataaacaggcaggagctagtcaggtgcatgtgccacactcacacaagacctggaattgacaggactcccaactagtacaatgacagaagataaggtcactgggaccctggttttcactgtcatcactgctgtgctgggttccttccagtttggatatgacattggtgtgatcaatgcacctcaacaggtaataatatctcactatagacatgttttgggtgttccactggatgaccgaaaagctatcaacaactatgttatcaacagtacagatgaactgcccacaatctcatactcaatgaacccaaaaccaaccccttgggctgaggaagagactgtggcagctgctcaactaatcaccatgctctggtccctgtctgtatccagctttgcagttggtggaatgactgcatcattctttggtgggtggcttggggacacacttggaagggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttcagtgtgatttgtttttcatttgggccaatttgggataaactattttcacttgggatttcaggatacagtcaaaataagcttaaataactcaggacatctttgtgctaaactgtgaactctggacaaaaatagagagtctctgaatagggcaggagcaggaaaatggctcctgggtggctcttgtatgcttcttcaggatgctgatggcctttgggaagcccagtgtaaacaatgataaaggagcttaacacttttataggtgatacatgtgatttaatcaaatcactattcctgatctcatttactaacagaataaagtggtaaatatttaaattaaaaattccaaagaccacttttaagtgcttcttcactattttgactggcccacaaacaccagaaattcagaccctgaagttttctgcctcagagaaatttaagtaccttataatgttccccttctacaacttttttcttgcagagatacatgtgagttgacaagaaacattaaagggaaataagaagaagctgataaagctttataggaggaccaaagaactagcttactataataaaaaaattttaagtcttcaagggtatacatcataa

SEQ ID NO: 1285 - DNA, 3284 bp, Homo sapiens
ctattcatgtttccaactacaactgcatatgaggtcatatcaaatatctcctgcacaaactatgtctatacctaggaacaagggttcatccttccagtgaattcagggaggggctttcattcaagatatatactgtacttaaaccaaattgttattattgagatagtcctggttgcactttaacatttatgtttatgtttcatgcagggctaatttcaggcctggttcctatgtatatcggtgaaattgctccaaccgctctcaggggagcacttggcacttttcatcagctggccatcgtcacgggcattcttattagtcaggcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttcagtgtgatttgtttttcatttgggccaatttgggataaactattttcacttgggatttcaggatacagtcaaaataagcttaaataactcaggacatctttgtgctaaactgtgaactctggacaaaaatagagagtctctgaatagggcaggagcaggaaaatggctcctgggtggctcttgtatgcttcttcaggatgctgatggcctttgggaagcccagtgtaaacaatgataaaggagcttaacacttttataggtgatacatgtgatttaatcaaatcactattcctgatctcatttactaacagaataaagtggtaaatatttaaattaaaaattccaaagaccacttttaagtgcttcttcactattttgactggcccacaaacaccagaaattcagaccctgaagttttctgcctcagagaaatttaagtaccttataatgttccccttctacaacttttttcttgcagagatacatgtgagttgacaagaaacattaaagggaaataagaagaagctgataaagctttataggaggaccaaagaactagcttactataataaaaaaattttaagtcttcaagggtatacatcataa

SEQ ID NO: 1286 - DNA, 3446 bp, Homo sapiens
ggtattcaaggtgcatgatggcgatattcgactgtagaaacgtggtaattgatggtgattacagagatgtatgtacatttgacatgagatgatagggtcaatagggatgctggttggcagtgttgtaagtgatgatgttgggttctcgtttcagtgttgaatatagagattgggtgtgatctaatgcacgcgtcaagctaggtgcaggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttcagtgtgatttgtttttcatttgggccaatttgggataaactattttcacttgggatttcaggatacagtcaaaataagcttaaataactcaggacatctttgtgctaaactgtgaactctggacaaaaatagagagtctctgaatagggcaggagcaggaaaatggctcctgggtggctcttgtatgcttcttcaggatgctgatggcctttgggaagcccagtgtaaacaatgataaaggagcttaacacttttataggtgatacatgtgatttaatcaaatcactattcctgatctcatttactaacagaataaagtggtaaatatttaaattaaaaattccaaagaccacttttaagtgcttcttcactattttgactggcccacaaacaccagaaattcagaccctgaagttttctgcctcagagaaatttaagtaccttataatgttccccttctacaacttttttcttgcagagatacatgtgagttgacaagaaacattaaagggaaataagaagaagctgataaagctttataggaggaccaaagaactagcttactataataaaaaaattttaagtcttcaagggtatacatcataa

SEQ ID NO: 1287 - DNA, 3984 bp, Homo sapiens
tctggtttgtaacttatgcctaagggacctgctcccattttctttcctagtggaacaaaggtattgaagccacaggttgctgaggcaaagcacttattgattagattcccatcaatattcagctgccgctgagaagattagacttggactctcaggtctgggtagcccaactcctccctctccttgctcctcctcctgcaatgcataactaggcctaggcagagctgcgaataaacaggcaggagctagtcaggtgcatgtgccacactcacacaagacctggaattgacaggactcccaactagtacaatgacagaagataaggtcactgggaccctggttttcactgtcatcactgctgtgctgggttccttccagtttggatatgacattggtgtgatcaatgcacctcaacaggtaataatatctcactatagacatgttttgggtgttccactggatgaccgaaaagctatcaacaactatgttatcaacagtacagatgaactgcccacaatctcatactcaatgaacccaaaaccaaccccttgggctgaggaagagactgtggcagctgctcaactaatcaccatgctctggtccctgtctgtatccagctttgcagttggtggaatgactgcatcattctttggtgggtggcttggggacacacttggaagaatcaaagccatgttagtagcaaacattctgtcattagttggagctctcttgatggggttttcaaaattgggaccatctcatatacttataattgctggaagaagcatatcaggactatattgtgggctaatttcaggcctggttcctatgtatatcggtgaaattgctccaaccgctctcaggggagcacttggcacttttcatcagctggccatcgtcacgggcattcttattagtcagattattggtcttgaatttatcttgggcaattatgatctgtggcacatcctgcttggcctgtctggtgtgcgagccatccttcagtctctgctactctttttctgtccagaaagccccagatacctttacatcaagttagatgaggaagtcaaagcaaaacaaagcttgaaaagactcagaggatatgatgatgtcaccaaagatattaatgaaatgagaaaagaaagagaagaagcatcgagtgagcagaaagtctctataattcagctcttcaccaattccagctaccgacagcctattctagtggcactgatgctgcatgtggctcagcaattttccggaatcaatggcattttttactactcaaccagcatttttcagacggctggtatcagcaaacctgtttatgcaaccattggagttggcgctgtaaacatggttttcactgctgtctctgtattccttgtggagaaggcagggcgacgttctctctttctaattggaatgagtgggatgtttgtttgtgccatcttcatgtcagtgggacttgtgctgctgaataagttctcttggatgagttatgtgagcatgatagccatcttcctctttgtcagcttctttgaaattgggccaggcccgatcccctggttcatggtggctgagtttttcagtcaaggaccacgtcctgctgctttagcaatagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgttgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttcagtgtgatttgtttttcatttgggccaatttgggataaactattttcacttgggatttcaggatacagtcaaaataagcttaaataactcaggacatctttgtgctaaactgtgaactctggacaaaaatagagagtctctgaatagggcaggagcaggaaaatggctcctgggtggctcttgtatgcttcttcaggatgctgatggcctttgggaagcccagtgtaaacaatgataaaggagcttaacacttttataggtgatacatgtgatttaatcaaatcactattcctgatctcatttactaacagaataaagtggtaaatatttaaattaaaaattccaaagaccacttttaagtgcttcttcactattttgactggcccacaaacaccagaaattcagaccctgaagttttctgcctcagagaaatttaagtaccttataatgttccccttctacaacttttttcttgcagagatacatgtgagttgacaagaaacattaaagggaaataagaagaagctgataaagctttataggaggaccaaagaactagcttactataataaaaaaattttaagtcttcaagggtatacatcataa

SEQ ID NO: 1288 - DNA, 2524 bp, Homo sapiens
gagagagagagagagagagagagagagagagagagagagagagagagagagagagagagagagagagagagagagagagagagagagagagagagagagagagctgcattcagcaattggacctgcaatttcattgtagctctgtgtttccagtacattgcggacttctgtggaccttatgtgtttttcctctttgctggagtgctcctggcctttaccctgttcacattttttaaagttccagaaaccaaaggaaagtcttttgaggaaattgctgcagaattccaaaagaagagtggctcagcccacaggccaaaagctgctgtagaaatgaaattcctaggagctacagagactgtgtaaaaaaaaaaccctgctttttgacatgaacagaaacaataagggaaccgtctgtttttaaatgatgattccttgagcattttatatccacatctttaagtattgttttatttttatgtgctctcatcagaaatgtcatcaaatattaccaaaaaagtatttttttaagttagagaatatatttttgatggtaagactgtaattaagtaaaccaaaaaggctagtttattttgttacactaaagggcaggtggttctaatatttttagctctgttctttataacaaggttcttctaaaattgaagagatttcaacatatcatttttttaacacataactagaaacctgaggatgcaacaaatatttatatatttgaatatcattaaattggaattttcttacccatatatcttatgttaaaggagatatggctagtggcaataagttccatgttaaaatagacaactcttccatttattgcactcagcttttttcttgagtactagaatttgtattttgcttaaaattttacttttgttctgtattttcatgtggaatggattatagagtatactaaaaaatgtctatagagaaaaactttcatttttggtaggcttatcaaaatctttcagcactcagaaaagaaaaccattttagttcctttatttaatggccaaatggtttttgcaagatttaacactaaaaaggtttcacctgatcatatagcgtgggttatcagttaacattaacatctattataaaaccatgttgattcccttctggtacaatcctttgagttatagtttgctttgctttttaattgaggacagcctggttttcacatacactcaaacaatcatgagtcagacatttggtatattacctcaaattcctaataagtttgatcaaatctaatgtaagaaaatttgaagtaaaggattgatcactttgttaaaaatattttctgaattattatgtctcaaaataagttgaaaaggtagggtttgaggattcctgagtgtgggcttctgaaacttcataaatgttcagcttcagacttttatcaaaatccctatttaattttcctggaaagactgattgttttatggtgtgttcctaacataaaataatcgtctcctttgacatttccttctttgtcttagctgtatacagattctagccaaactattctatggccattactaacacgcattgtacactatctatctgcctttacctacataggcaaattggaaatacacagatgattaaacagactttagcttacagtcaattttacaattatggaaatatagttctgatgggtcccaaaagcttagcagggtgctaacgtatctctaggctgttttctccaccaactggagcactgatcaatccttcttatgtttgctttaatgtgtattgaagaaaagcactttttaaaaagtactctttaagagtgaaataattaaaaaccactgaacatttgctttgttttctaaagttgttcacatatatgtaatttagcagtccaaagaacaagaaattgtttcttttcagtgtgatttgtttttcatttgggccaatttgggataaactattttcacttgggatttcaggatacagtcaaaataagcttaaataactcaggacatctttgtgctaaactgtgaactctggacaaaaatagagagtctctgaatagggcaggagcaggaaaatggctcctgggtggctcttgtatgcttcttcaggatgctgatggcctttgggaagcccagtgtaaacaatgataaaggagcttaacacttttataggtgatacatgtgatttaatcaaatcactattcctgatctcatttactaacagaataaagtggtaaatatttaaattaaaaattccaaagaccacttttaagtgcttcttcactattttgactggcccacaaacaccagaaattcagaccctgaagttttctgcctcagagaaatttaagtaccttataatgttccccttctacaacttttttcttgcagagatacatgtgagttgacaagaaacattaaagggaaataagaagaagctgataaagctttataggaggaccaaagaactagcttactataataaaaaaattttaagtcttcaagggtatacatcataa

SEQ ID NO: 1289 - DNA, 420 bp, Homo sapiens
cattcaatagttccatatttatcagtttgtgtatatgtagagaaaaaaaatcatgaacatactatccagcacttcttcttcaagttatttaaaggctcttaacggtaaaaaagaaataataataagataaaaattaaatcagccggttgcagtggctcatgcctgtaatcccagcactttgagaggccaaggcaggcagatcatgaggtcaggtgattgagaccatcctggctaatacggtgaaaccccatctctactaaaactacaaaaaactagccgggtgtggtggcgggagcctgtactccctgctactaggtaggctgaggtaggagaatggcatgaacccaggaggtggagcttgcagtgagccatggtcgcgctactacactccagcctgggtgaaagagcaagattctgtct

SEQ ID NO: 1290 - DNA, 982 bp, Homo sapiens
gtgacagagagagactccgtctaaaaaaaaaaaaaaaagaaagaaaaagaaattagaaatttcaaactgtgtaaattatttgtcctgtagtaaccatattttgttttattacgtcagtaatttgctaaaattagtcataatctaagatatgatcaggctagcaagacacttgaaaaatgtcaagaccctataaaactgatttgtgttcagaattttcaaaaacatcttgttctcttcccttcactaaatgtcagtattcttgactccttttctaaaactctaataatttcatttttgtgtaacatttttatgaaggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttaggtaaaaaacaatctgttgcttaatttgtagtgaaatttgtgtgtcacctgggtagtttcttcaggccaaaagtgaaatgtggaaaattgtttggacaccggtgtttatgctcatattagtaacagccttttaggaaactgataacctcatcttttttagtaaattatagtaaatttatggcaaatgaacagatctctagatcagcagttcccaatgtatggtgtatggaccagtgggatactagggacccttttagagggtctacaaggtcaaaacagtttgcctaataataccaagatgtcacttgactttctcactgtgttgctcagatggtacaaaagcaatagtgggtaaaactgttgaagctttagacaagatcaaggcaggggcaccaaactgtactagcagtacatagttacatagttaat

SEQ ID NO: 1291 - DNA, 533 bp, Homo sapiens
  misc_feature (1)..(1): n is a, c, g, or t
ncactgcaacctctacctcatgggttccagggattctcctgcttttgtatttttagtagaaatggggtttcaccaggttagccaggctggtctcaaactcctgacctcaggtgatccgcctgccttggcctcccaaagtgctgggattataggcctgagccactgcgcccggcctctcttctttgtttttgttttttgtttttttgttttttttttttgagatggggtctcgctctgttgcccagggctgaggcacaagaattgtttgaacccgggtggcagaggttgcagtgagctgagatcatgccactgcgctcctagcctgggtgacagagcaagactccatctcaatttaaaacaaaaaaagaatgtgtttttaattttgttaatgtttgtctgttatacatagcactggtaccgcaaacattttacttaaactcttaatagcatttctttcgccagatactttaatatttcaccttacattaatcctggattcacatttctttaattgaaataaatgttaatgacaa

SEQ ID NO: 1292 - DNA, 4657 bp, Homo sapiens
  misc_feature (2690)..(2690): n is a, c, g, or t
cccgtcacccgcccggtccatgtccctgcagaccgtcccgcccgcgcacagcggcgggaaccccagcttctgcgcgcccggccgcgccccgggcctctgccccgcctcgctcccgctgcccggcgcctttgtccgctctgcgcccctggagtttctgtgcctccacgggcgggagcggggcgcgaaggtctgggggtgccccgaggacgcgccgcgtagtgagcctccgggcccaagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaacaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaatttgcaggaggtatttattccaggctggaagcacaaatcaaggcctcagtgccagttagtgcacgccaaagcagctcagagaaaaacacaaggtctaaaagtcgttttggtcaagggcgtcctgcataaagtaccttaaaatataagtaaaaagagagaaggcactcttctggacatctgaaattgctcacttcttgaagatcttcagaacaatgacttccaactgttttatgttattattattttaatccacataaatcataattctaaaagaaatncatagttaggttttatgaaaatctaattgtaaatatgaaactttttaaatctgattttcttctaatatcattctaggctatgtagaaagcaattatttacaaatttgcatagttgagactcccagtgttttcctttatttatttgaaaaagaaaggcctaaactgtcaggtagccaagtttttttaagaccttaaaagttaggggaacacaactggtagtgttaccatgcatggcactgattgtagtatgtctttggagctgtaaatcttgagatagcattgagaactgcaggttgtgtgacgaaattcccaatgatgctaattttaagtctgcatgaatattaaggagtgacaggtctcaagactgcattaaatgaagtttcagggtaaggtatttcagtactgtgttgggcagaagggttaatttttttcagcattatatcgtggaaagtacaatgttaatccaacttttttttctttcagtttttaatgcttatctattgatcatctgagctggaattactgattattactctgtcctctgtgaaactagtggcattctgaatttggtaaaataaccattgatagttttaggatagtaaatcatttctgttatatgagacacccactgtacagttctcagggctctaaaacccaaccatatttctgtaaccattcaaataactccttgaaacagttatacttgctagttcggtctaaaattttccaaatacattagataggtgaaaatttgcatatattcaagaaaaatcaaaataaaattctattttataaatcatgtttaaatttttctagccaggcagaaagagtgctcagggaaaatttgttccaaactataaccatataataaattatgtgtttgtaaattatatgtaggtctctgaaaaactttaagatgcactgtttctatttttttaagtcttaatttgccttataactgacatttcttcaaattattcagagaacagactttaataatgtgtgacaaaagagcaatttccattgaaatattgaagtgttacactcagtttacacgtacagaaatcattctttttagtgagtcttttagttgataaatgaagctagatgttatttgataactggctttgccaaggtttttgaactgctgtttagaaattttgttcccatttatatttgtttcaattgtttgatactgtggaaatagacttttattttcgaaagaaaatgtcttgtagtacatattatatgtaagtactctgttaaataccagagttttttttgtagtttactgtgttttctgattaaaggatttggatttgtacatgtaaacagtgctgtaatggtcacgactagataaggaaaaaatatatatgctcttttgatttttaactgatggtaaaaaggcaaactgcttctcccctgggaggcctataccactgaattaatttttacaaaccagagtttatcagaatttgattctcttcagaatgcttttggccaggtgtagtggctcacgccagtaatcccagcactttgggaggccgaggcgggcagatcacctgaggtcaggagtttgagaccagcctggccaacgtggtgaaaccctatctctactaaaaatacaaaaagattagccaggcatggtggcatacacctgtagtcccagctactcgggaggctgaggcacaagaattgtttgaacccgggtggcagaggttgcagtgagctgagatcatgccactgcgctcctagcctgggtgacagagcaagactccatctcaatttaaaacaaaaaaagaatgtgtttttaattttgttaatgtttgtctgttatacatagcactggtaccgcaaacattttacttaaactcttaatagcatttctttcgccagatactttaatatttcaccttacattaatcctggattcacatttctttaattgaaataaatgttaatgacaa

SEQ ID NO: 1293 - DNA, 4573 bp, Homo sapiens
  misc_feature (2606)..(2606): n is a, c, g, or t
tccgcagccgcctgcaagcgggcgggggcggggtgtgaggcgctgcggacggggttgcgggctcggtagcggcagcttcagggcgcgagcgcgggcggtgccgaccactgcaggtaacagaggcgctgcgagggcagccgcggccctgtggagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaacaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaatttgcaggaggtatttattccaggctggaagcacaaatcaaggcctcagtgccagttagtgcacgccaaagcagctcagagaaaaacacaaggtctaaaagtcgttttggtcaagggcgtcctgcataaagtaccttaaaatataagtaaaaagagagaaggcactcttctggacatctgaaattgctcacttcttgaagatcttcagaacaatgacttccaactgttttatgttattattattttaatccacataaatcataattctaaaagaaatncatagttaggttttatgaaaatctaattgtaaatatgaaactttttaaatctgattttcttctaatatcattctaggctatgtagaaagcaattatttacaaatttgcatagttgagactcccagtgttttcctttatttatttgaaaaagaaaggcctaaactgtcaggtagccaagtttttttaagaccttaaaagttaggggaacacaactggtagtgttaccatgcatggcactgattgtagtatgtctttggagctgtaaatcttgagatagcattgagaactgcaggttgtgtgacgaaattcccaatgatgctaattttaagtctgcatgaatattaaggagtgacaggtctcaagactgcattaaatgaagtttcagggtaaggtatttcagtactgtgttgggcagaagggttaatttttttcagcattatatcgtggaaagtacaatgttaatccaacttttttttctttcagtttttaatgcttatctattgatcatctgagctggaattactgattattactctgtcctctgtgaaactagtggcattctgaatttggtaaaataaccattgatagttttaggatagtaaatcatttctgttatatgagacacccactgtacagttctcagggctctaaaacccaaccatatttctgtaaccattcaaataactccttgaaacagttatacttgctagttcggtctaaaattttccaaatacattagataggtgaaaatttgcatatattcaagaaaaatcaaaataaaattctattttataaatcatgtttaaatttttctagccaggcagaaagagtgctcagggaaaatttgttccaaactataaccatataataaattatgtgtttgtaaattatatgtaggtctctgaaaaactttaagatgcactgtttctatttttttaagtcttaatttgccttataactgacatttcttcaaattattcagagaacagactttaataatgtgtgacaaaagagcaatttccattgaaatattgaagtgttacactcagtttacacgtacagaaatcattctttttagtgagtcttttagttgataaatgaagctagatgttatttgataactggctttgccaaggtttttgaactgctgtttagaaattttgttcccatttatatttgtttcaattgtttgatactgtggaaatagacttttattttcgaaagaaaatgtcttgtagtacatattatatgtaagtactctgttaaataccagagttttttttgtagtttactgtgttttctgattaaaggatttggatttgtacatgtaaacagtgctgtaatggtcacgactagataaggaaaaaatatatatgctcttttgatttttaactgatggtaaaaaggcaaactgcttctcccctgggaggcctataccactgaattaatttttacaaaccagagtttatcagaatttgattctcttcagaatgcttttggccaggtgtagtggctcacgccagtaatcccagcactttgggaggccgaggcgggcagatcacctgaggtcaggagtttgagaccagcctggccaacgtggtgaaaccctatctctactaaaaatacaaaaagattagccaggcatggtggcatacacctgtagtcccagctactcgggaggctgaggcacaagaattgtttgaacccgggtggcagaggttgcagtgagctgagatcatgccactgcgctcctagcctgggtgacagagcaagactccatctcaatttaaaacaaaaaaagaatgtgtttttaattttgttaatgtttgtctgttatacatagcactggtaccgcaaacattttacttaaactcttaatagcatttctttcgccagatactttaatatttcaccttacattaatcctggattcacatttctttaattgaaataaatgttaatgacaa

SEQ ID NO: 1294 - DNA, 4479 bp, Homo sapiens
  misc_feature (2512)..(2512): n is a, c, g, or t
tccgcagccgcctgcaagcgggcgggggcggggtgtgaggcgctgcggacggggttgcgggctcggtagcggcagcttcagggcgcgagcgcgggcggtgccgaccactgcaggtaacagaggcgctgcgagggcagccgcggccctgtggagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaacaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaatttgcaggaggtatttattccaggctggaagcacaaatcaaggcctcagtgccagttagtgcacgccaaagcagctcagagaaaaacacaaggtctaaaagtcgttttggtcaagggcgtcctgcataaagtaccttaaaatataagtaaaaagagagaaggcactcttctggacatctgaaattgctcacttcttgaagatcttcagaacaatgacttccaactgttttatgttattattattttaatccacataaatcataattctaaaagaaatncatagttaggttttatgaaaatctaattgtaaatatgaaactttttaaatctgattttcttctaatatcattctaggctatgtagaaagcaattatttacaaatttgcatagttgagactcccagtgttttcctttatttatttgaaaaagaaaggcctaaactgtcaggtagccaagtttttttaagaccttaaaagttaggggaacacaactggtagtgttaccatgcatggcactgattgtagtatgtctttggagctgtaaatcttgagatagcattgagaactgcaggttgtgtgacgaaattcccaatgatgctaattttaagtctgcatgaatattaaggagtgacaggtctcaagactgcattaaatgaagtttcagggtaaggtatttcagtactgtgttgggcagaagggttaatttttttcagcattatatcgtggaaagtacaatgttaatccaacttttttttctttcagtttttaatgcttatctattgatcatctgagctggaattactgattattactctgtcctctgtgaaactagtggcattctgaatttggtaaaataaccattgatagttttaggatagtaaatcatttctgttatatgagacacccactgtacagttctcagggctctaaaacccaaccatatttctgtaaccattcaaataactccttgaaacagttatacttgctagttcggtctaaaattttccaaatacattagataggtgaaaatttgcatatattcaagaaaaatcaaaataaaattctattttataaatcatgtttaaatttttctagccaggcagaaagagtgctcagggaaaatttgttccaaactataaccatataataaattatgtgtttgtaaattatatgtaggtctctgaaaaactttaagatgcactgtttctatttttttaagtcttaatttgccttataactgacatttcttcaaattattcagagaacagactttaataatgtgtgacaaaagagcaatttccattgaaatattgaagtgttacactcagtttacacgtacagaaatcattctttttagtgagtcttttagttgataaatgaagctagatgttatttgataactggctttgccaaggtttttgaactgctgtttagaaattttgttcccatttatatttgtttcaattgtttgatactgtggaaatagacttttattttcgaaagaaaatgtcttgtagtacatattatatgtaagtactctgttaaataccagagttttttttgtagtttactgtgttttctgattaaaggatttggatttgtacatgtaaacagtgctgtaatggtcacgactagataaggaaaaaatatatatgctcttttgatttttaactgatggtaaaaaggcaaactgcttctcccctgggaggcctataccactgaattaatttttacaaaccagagtttatcagaatttgattctcttcagaatgcttttggccaggtgtagtggctcacgccagtaatcccagcactttgggaggccgaggcgggcagatcacctgaggtcaggagtttgagaccagcctggccaacgtggtgaaaccctatctctactaaaaatacaaaaagattagccaggcatggtggcatacacctgtagtcccagctactcgggaggctgaggcacaagaattgtttgaacccgggtggcagaggttgcagtgagctgagatcatgccactgcgctcctagcctgggtgacagagcaagactccatctcaatttaaaacaaaaaaagaatgtgtttttaattttgttaatgtttgtctgttatacatagcactggtaccgcaaacattttacttaaactcttaatagcatttctttcgccagatactttaatatttcaccttacattaatcctggattcacatttctttaattgaaataaatgttaatgacaa

SEQ ID NO: 1295 - DNA, 2610 bp, Homo sapiens
  misc_feature (643)..(643): n is a, c, g, or t
cgaatgactgaaattacagggcacctaataaaaatgagattgggggatctggaccgagtcaagtcaaaggaagcaaaagaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaatttgcaggaggtatttattccaggctggaagcacaaatcaaggcctcagtgccagttagtgcacgccaaagcagctcagagaaaaacacaaggtctaaaagtcgttttggtcaagggcgtcctgcataaagtaccttaaaatataagtaaaaagagagaaggcactcttctggacatctgaaattgctcacttcttgaagatcttcagaacaatgacttccaactgttttatgttattattattttaatccacataaatcataattctaaaagaaatncatagttaggttttatgaaaatctaattgtaaatatgaaactttttaaatctgattttcttctaatatcattctaggctatgtagaaagcaattatttacaaatttgcatagttgagactcccagtgttttcctttatttatttgaaaaagaaaggcctaaactgtcaggtagccaagtttttttaagaccttaaaagttaggggaacacaactggtagtgttaccatgcatggcactgattgtagtatgtctttggagctgtaaatcttgagatagcattgagaactgcaggttgtgtgacgaaattcccaatgatgctaattttaagtctgcatgaatattaaggagtgacaggtctcaagactgcattaaatgaagtttcagggtaaggtatttcagtactgtgttgggcagaagggttaatttttttcagcattatatcgtggaaagtacaatgttaatccaacttttttttctttcagtttttaatgcttatctattgatcatctgagctggaattactgattattactctgtcctctgtgaaactagtggcattctgaatttggtaaaataaccattgatagttttaggatagtaaatcatttctgttatatgagacacccactgtacagttctcagggctctaaaacccaaccatatttctgtaaccattcaaataactccttgaaacagttatacttgctagttcggtctaaaattttccaaatacattagataggtgaaaatttgcatatattcaagaaaaatcaaaataaaattctattttataaatcatgtttaaatttttctagccaggcagaaagagtgctcagggaaaatttgttccaaactataaccatataataaattatgtgtttgtaaattatatgtaggtctctgaaaaactttaagatgcactgtttctatttttttaagtcttaatttgccttataactgacatttcttcaaattattcagagaacagactttaataatgtgtgacaaaagagcaatttccattgaaatattgaagtgttacactcagtttacacgtacagaaatcattctttttagtgagtcttttagttgataaatgaagctagatgttatttgataactggctttgccaaggtttttgaactgctgtttagaaattttgttcccatttatatttgtttcaattgtttgatactgtggaaatagacttttattttcgaaagaaaatgtcttgtagtacatattatatgtaagtactctgttaaataccagagttttttttgtagtttactgtgttttctgattaaaggatttggatttgtacatgtaaacagtgctgtaatggtcacgactagataaggaaaaaatatatatgctcttttgatttttaactgatggtaaaaaggcaaactgcttctcccctgggaggcctataccactgaattaatttttacaaaccagagtttatcagaatttgattctcttcagaatgcttttggccaggtgtagtggctcacgccagtaatcccagcactttgggaggccgaggcgggcagatcacctgaggtcaggagtttgagaccagcctggccaacgtggtgaaaccctatctctactaaaaatacaaaaagattagccaggcatggtggcatacacctgtagtcccagctactcgggaggctgaggcacaagaattgtttgaacccgggtggcagaggttgcagtgagctgagatcatgccactgcgctcctagcctgggtgacagagcaagactccatctcaatttaaaacaaaaaaagaatgtgtttttaattttgttaatgtttgtctgttatacatagcactggtaccgcaaacattttacttaaactcttaatagcatttctttcgccagatactttaatatttcaccttacattaatcctggattcacatttctttaattgaaataaatgttaatgacaa

SEQ ID NO: 1296 - DNA, 2618 bp, Homo sapiens
cccgtcacccgcccggtccatgtccctgcagaccgtcccgcccgcgcacagcggcgggaaccccagcttctgcgcgcccggccgcgccccgggcctctgccccgcctcgctcccgctgcccggcgcctttgtccgctctgcgcccctggagtttctgtgcctccacgggcgggagcggggcgcgaaggtctgggggtgccccgaggacgcgccgcgtagtgagcctccgggcccaagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaacaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaaacagacaaactgagacccagagacggcactgtgtctaagagcaacagaaaaagtggtttgagcagtgtgctcttgatgacagtgttgctgtgttaaacgaattaatacatgaaaggacttggaatactgcttgacatatcgtaagtgctcaaaaatgttagctattattagtagaccacatgaaagacttttagaaataactgtat

SEQ ID NO: 1297 - DNA, 1482 bp, Homo sapiens
cccgtcacccgcccggtccatgtccctgcagaccgtcccgcccgcgcacagcggcgggaaccccagcttctgcgcgcccggccgcgccccgggcctctgccccgcctcgctcccgctgcccggcgcctttgtccgctctgcgcccctggagtttctgtgcctccacgggcgggagcggggcgcgaaggtctgggggtgccccgaggacgcgccgcgtagtgagcctccgggcccaagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaacaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttaggtaaaaaacaatctgttgcttaatttgtagtgaaatttgtgtgtcacctgggtagtttcttcaggccaaaagtgaaatgtggaaaattgtttggacaccggtgtttatgctcatattagtaacagccttttaggaaactgataacctcatcttttttagtaaattatagtaaatttatggcaaatgaacagatctctagatcagcagttcccaatgtatggtgtatggaccagtgggatactagggacccttttagagggtctacaaggtcaaaacagtttgcctaataataccaagatgtcacttgactttctcactgtgttgctcagatggtacaaaagcaatagtgggtaaaactgttgaagctttagacaagatcaaggcaggggcaccaaactgtactagcagtacatagttacatagttaat

SEQ ID NO: 1298 - DNA, 1521 bp, Homo sapiens
cccgtcacccgcccggtccatgtccctgcagaccgtcccgcccgcgcacagcggcgggaaccccagcttctgcgcgcccggccgcgccccgggcctctgccccgcctcgctcccgctgcccggcgcctttgtccgctctgcgcccctggagtttctgtgcctccacgggcgggagcggggcgcgaaggtctgggggtgccccgaggacgcgccgcgtagtgagcctccgggcccaagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaacaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaagggccaaacatggtgatccatgtgtgtgatgaagcaaaaaacttgaaagaagattttacttgcccgcgagatcttttgatatcagaaatgaagtactttgctgaatatttatctatggatgcccagcgctgggaagaggtggacatttcagttcattgcgacgttcacattttcaactggttgataaaatacattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataaggtgtcgtgaagataaaatacatacatgtatttttgtatatatatatata

SEQ ID NO: 1299 - DNA, 386 bp, Homo sapiens
gaaagttcaaaaagctgaaagtgttttcatacatttgtagcaattcaaacttgcactgagctgctgtgataccatttatattttttattcatcccacttatatttgattatggggcactgctccagatccattatatacaatgtacataacgtattatctctgagaagtaacaaatctcaattccaaaaatacatctcctgttaagagttttagaaaatggattacggagctgcaagaagatttattaaaccttgatgttgccaagccaacataatctaaaggagcaccaacttcctattgttttagaagcaattctgacctccttttctgtttaaaaaatctaggtctaaaagtcgttttggtcaagggcgtcctgcataaagta

SEQ ID NO: 1300 - DNA, 647 bp, Homo sapiens
gaaaaagaaaatgaacccctgtaaagcaatttcagcttatgaacccctgtaaagcaatttcagctttgcttcatggtatatttgctttctatccagaggttaatttgttagttttcttaaaacaatgtttttcttaatggtcttattgtttagaagtaacaagtggactggaaaagtatatggggcctaagtttataacattgtcttctcattatcagggaaaaaggagaagccaaagaagttcactagacaaccaaaaaagcaggtatcttcaccctgtgcccagaggaaagaaaaggcattggagaaggtaactctgaattatctgttgttaaagttcatatggaaaaataagcatgtgagtatagccagaaaaaaataaaaagagtaatgaagacacatggaatgctagcaatgtaaaaatgaagttttttatagactgagattaaagatctctaagatatattgacaaatgagaaaaggaaggtgcagaaacgtatagtggtatagtatgctaccatttgtgtaaagtagatgggggaaatatataaataacttccttgtatatgcataaaatgtttctggaagggctacataagaactcgataaaattggttgcctctcaggaagggaactgaacgtgtaag

SEQ ID NO: 1301 - DNA, 3688 bp, Homo sapiens
  misc_feature (1721)..(1721): n is a, c, g, or t
ctcagaaacagtggtttatcctactgcagcaagttcattaaaaggaacactaaggagaataaagattgtgagatgcccactttagagccaggaaatgtcatttcaattcttatttcttcggagtttttaaaaatggattcactagttgaacagtgtattcagtattgccacaaaaatatgaatgccatagtagctaccccatgcaacatgaactgtattaatgcaaatcttctcacacgtatagctgatctgttctcacacaatgaagttgatgatttaaaggacaaaaaagataaatttaaaagcaaacttttttgtaagaagattgaaagactgtttgatcctgagtacttgaatccagattctcggagtaatgcagcaacattgtatagatgctgtttgtgtaagaaacttttaacaaaagaaacagaaagaagaattccttgcattcctggaaaaatcaatgtggatcgacgtggaaatattgtctatattcacataagagataagacatgggatgttcatgagtatttgaatagtcttttcgaagaattaaaatcttggagagatgtatactggcgattgtggggaacaatcaattggctgacttgttcaagatgttatcaggcctttctctgtattgaattttcacattgtcaataccactcagaaacagtggtttatcctactgcagcaagttcattgaatactgttggcactggaatttatccctgctgtaaccaaaaggttcttcggtttgatcctactcagcttacaaagggctgtaaagtgagggaccacatggttacacttcgtgatcaaggtgaaggcggagatttgccgtcctgtcccactgctagaatgttggacgatttgcacaagtacagagatgtcattgttgtgcctttttcaaaagatacagttagtgatgttggggttggcctctgtgatgaaaagggtatagaatgtgatgttttactggagccaaatacaccatggggtcccaaaactggggagctcaatgctttcttgtcattgaaaaactggactctacaactgaaacaacagtcactgttttcagaagaagaagaatataccactggatctgaggtcactgaagatgaagttggagatgaagaagaagtatccaagaaacaaaggaaaaaggagaagccaaagaagttcactagacaaccaaaaaagcaggtatcttcaccctgtgcccagaggaaagaaaaggcattggagaagtcagcttctagagatgtgtctcctttcgttatgagtatgcagaagaataagtgggatgccacaagatccttgagattcaaccaggatgcacaaagagaagacgatcaacggcgaatgactgaaattacagggcacctaataaaaatgagattgggggatctggaccgagtcaagtcaaaggaagcaaaagaatttgcaggaggtatttattccaggctggaagcacaaatcaaggcctcagtgccagttagtgcacgccaaagcagctcagagaaaaacacaaggtctaaaagtcgttttggtcaagggcgtcctgcataaagtaccttaaaatataagtaaaaagagagaaggcactcttctggacatctgaaattgctcacttcttgaagatcttcagaacaatgacttccaactgttttatgttattattattttaatccacataaatcataattctaaaagaaatncatagttaggttttatgaaaatctaattgtaaatatgaaactttttaaatctgattttcttctaatatcattctaggctatgtagaaagcaattatttacaaatttgcatagttgagactcccagtgttttcctttatttatttgaaaaagaaaggcctaaactgtcaggtagccaagtttttttaagaccttaaaagttaggggaacacaactggtagtgttaccatgcatggcactgattgtagtatgtctttggagctgtaaatcttgagatagcattgagaactgcaggttgtgtgacgaaattcccaatgatgctaattttaagtctgcatgaatattaaggagtgacaggtctcaagactgcattaaatgaagtttcagggtaaggtatttcagtactgtgttgggcagaagggttaatttttttcagcattatatcgtggaaagtacaatgttaatccaacttttttttctttcagtttttaatgcttatctattgatcatctgagctggaattactgattattactctgtcctctgtgaaactagtggcattctgaatttggtaaaataaccattgatagttttaggatagtaaatcatttctgttatatgagacacccactgtacagttctcagggctctaaaacccaaccatatttctgtaaccattcaaataactccttgaaacagttatacttgctagttcggtctaaaattttccaaatacattagataggtgaaaatttgcatatattcaagaaaaatcaaaataaaattctattttataaatcatgtttaaatttttctagccaggcagaaagagtgctcagggaaaatttgttccaaactataaccatataataaattatgtgtttgtaaattatatgtaggtctctgaaaaactttaagatgcactgtttctatttttttaagtcttaatttgccttataactgacatttcttcaaattattcagagaacagactttaataatgtgtgacaaaagagcaatttccattgaaatattgaagtgttacactcagtttacacgtacagaaatcattctttttagtgagtcttttagttgataaatgaagctagatgttatttgataactggctttgccaaggtttttgaactgctgtttagaaattttgttcccatttatatttgtttcaattgtttgatactgtggaaatagacttttattttcgaaagaaaatgtcttgtagtacatattatatgtaagtactctgttaaataccagagttttttttgtagtttactgtgttttctgattaaaggatttggatttgtacatgtaaacagtgctgtaatggtcacgactagataaggaaaaaatatatatgctcttttgatttttaactgatggtaaaaaggcaaactgcttctcccctgggaggcctataccactgaattaatttttacaaaccagagtttatcagaatttgattctcttcagaatgcttttggccaggtgtagtggctcacgccagtaatcccagcactttgggaggccgaggcgggcagatcacctgaggtcaggagtttgagaccagcctggccaacgtggtgaaaccctatctctactaaaaatacaaaaagattagccaggcatggtggcatacacctgtagtcccagctactcgggaggctgaggcacaagaattgtttgaacccgggtggcagaggttgcagtgagctgagatcatgccactgcgctcctagcctgggtgacagagcaagactccatctcaatttaaaacaaaaaaagaatgtgtttttaattttgttaatgtttgtctgttatacatagcactggtaccgcaaacattttacttaaactcttaatagcatttctttcgccagatactttaatatttcaccttacattaatcctggattcacatttctttaattgaaataaatgttaatgacaa

SEQ ID NO: 1302 - DNA, 1009 bp, Homo sapiens
cccgtcacccgcccggtccatgtccctgcagaccgtcccgcccgcgcacagcggcgggaaccccagcttctgcgcgcccggccgcgccccgggcctctgccccgcctcgctcccgctgcccggcgcctttgtccgctctgcgcccctggagtttctgtgcctccacgggcgggagcggggcgcgaaggtctgggggtgccccgaggacgcgccgcgtagtgagcctccgggcccaagatgaggaaattgaggcacagagattaactaatctgaaccagataatgccataagtagtagaactgcgatgcaaacttggacagtctgactccagagtctgcacacttaaccactccactattctggccttctacaagttccaaaagatgagtcgtggatattcagaaaacaacaatttcctgaacaataataaccaaatggtattggacatgatcctttatccattaattggaatccctcagactatcaactgggaaactatagcaaggctcgtgcctggattaacaccaaaagagtgtgcaaaacaggtttgatgaattaaagagcagtggaagctcgcctgttgacaaccagtataattccctaatggctgctggagagagtcctgttgaaactttagccacatatatcaaatcctcacttcttgacatacatggagaatttcaggagactccagttggacatgatgcagtttccaaaactggaagacatagtatagcttccacaaggaattgttcttcagaaagtgaaaattgtactactcataatggtggagaaatgactgaagaatctgaaggagacgtggtctcactgtgttgcccagtctggtcctgaactcctgggctcaagcagtcctcccacttcagactcccaaggtgctgggattacagttgtgagccaccgtgcctggacctccaataatgtacttttttttgtatcaggaatgtgtgaattaaacacacaattcaattaaattcatgttgtaggacag

SEQ ID NO: 1303 - DNA, 286 bp, Homo sapiens
aggattaaatcagttagcattatttttttctgtttgtaaaaggaaaaacttattaaatttttaaacggagttattaaacagagtttcactcttattgcccaggctggagtgcaaatatattgtggcaaatataaaatttgctagaaaatacatcttagaaattaagttataagagagcaaatggtaagtgaagaattttaaatttaattttctatgatatagcataacatacatttccatgcagaatcttttatttttaaatgtgaaatttaaaggttgcaaaata

SEQ ID NO: 1304 - DNA, 265 bp, Homo sapiens
gcgcctctggagggagggccccgggcagtgccagcaggaacgagcctgcctcagagccccaagtctcagtggagctccttccaggctgacatggggctgacggctcccggggccagcagggcgcccgcccgacaccaccacaacccatttcagtgacagataacttcagacaacttatcagagggccttggagggccggaggcagcaacacacacagcctgattctgggagcagcatttccttccaaaaaccttaaatcggataa

SEQ ID NO: 1305 - DNA, 471 bp, Homo sapiens
gagattttatttcttttgctggtgttggttctgggtgcaagtgatgaatgacgctcttgcgagtgaatgttgagtggtgtgtggataatgactcagttaggactacaggcacatgccaccatgccaggctaattgttttaatttttttttttttttgagacagtctctctctgtctcccaggctggagtgcagtggcacaatctcaattcttctgcctcagcctctggagtagctgagactgcaggtgcacaccaccatgccggctaatttttgtatttttagtagagacagggtttccccgtgttggccaggctggtctggaattcctggcctcaagtgacccgccctgcctcagcctcccaagtgctgggattacaggcatgggccgcccgggcttaatttttttttatttttatttttgcagagatggagtcttcctgtgttgcctagggttgtctcaaactcctggc

SEQ ID NO: 1306 - DNA, 383 bp, Homo sapiens
tctttggaccttaacccaccttcatgcagttgttcagcaccttctttcatctaaaacctgacggaatctggttgaaccttcctgtcctgtcttctggtttctgagtggatttgacccagggcaactgagaagaggcactgctttatctttttgccttctcactagagaatgagaccctactgcagtgtcctctctcttcagtccctgcatcttccatccacaaaacattgtcaagtgtgtcagtgacttacatccctaattaacttaatgatctcaacgtcagagaaaaacacctgtaaaacttttctctctccctgattgtaacaaaaacacaatcccatgatagaaaacttggaaaatgcagaggaagtaaaaagaagaaa

SEQ ID NO: 1307 - DNA, 799 bp, Homo sapiens
gaattaggagtttgtctaaggatataccagttggctgtcctaagaaacaaggagcattcattaccaaggagaatggactttgatcaaaggtctatcagcctcatccaggaactagatttttttaagggaagcagatctatttctgaaagtcagatttataataaagctcaaaaaactgagctataaacctgtaataccagcagactttcaataagagactcttacaactcaattgtggaaaaactaataattaaaaatgggcaaaggacctgagcagacatttctccaaagaagacataagaaatggccagtaggtatagatatgaaaaggtgttcagcatcattaatcataagaataatgtaaattaaaaccactgtgagctatcacctcacatctataagaatggctattaacaagacatgagataaatgttgatgagattgtggagaaaagagaaccctagtacactgtttgtgggcgtgtagactggggcagccgttatggaaaacggtatggaggctcctaaagaaattaaaaatagaactgttatctgaccctcttctgagtaagtatgtacccaaagaagatgaaatcaccagctgggcgcagtgactcacacctgtaatcccagcactttggagtgggtgaatcacctgaggtcaggagttcaagaccagcttgaccaacatggtgaaaccccgtctctactaaaaatacaaaaagtaggcgggcatggtgacgggcacctgtaatcccagctacttgggaggctgaggcagaagaatcacttgaactcgg

SEQ ID NO: 1308 - DNA, 129 bp, Homo sapiens
caagtcctaagccaacttggttatgggctgagctcagcatggcctgcattttgttttctgggctcctccaaactcaacacaaaacaaataactttgaaacagctaacatttcataaagcagcaaagatg

SEQ ID NO: 1309 - DNA, 1026 bp, Homo sapiens
gtagtggtttacccagatgttcaaaacattccatgtgataatgtgttttgtgaagagtgtatgagtgctatctagtgtctctattcccagatggccaggctcacaagcccaccagggaagatcccagctggaggggcttccacattttcctgatgaggagctattttagatttcctcaaaatcttttgattgctgccaaaagggagaagggtttgcagctgctggtcaggcattctcctttccttgccagaaccctgactgactcagggcagtaggtgaggctgcaacatcaaccagtccggtgacgctgacacacagctttggggtcagcctgtcacactacccggctccagttgcttaacggactcccagaggccatgatgctcagaagtaaaaagatgcaagcagcaatctggaattcagtggcccccaactttatagatagagggatagatagaaaatattagaacttccacttgtatttttaaattaaaaatctgactggggtggggggaatggggcattgtttaatatgtatagactttcagtttttgcaagatgaaaataattctggagattggttgcacaacagtatgaatgtatttaacactactgaacgttacacttaaaaatggttatgatggtaaattttgttatatgtattttacaacttaacatttttcaaaaaataaaaataaatttaaaaagtaatttactctcaacattaaaattgaaaatattttccaaattatttttgttacagttttaatttcctctttgatttaagggtaatgtttgaagataaccttttttaaaaaagtcattgttttgagtgtgatgttaattattaatgtcattaaactgcaagctattcaatgtctataatttagaaatttactgaactttatactgtggcatatgaacaattttttacatcttccaaagacatttgaatataatatgtattctccattgataaaatatgtagttcaagctatagctgttaaataaagctatttgaatttg

SEQ ID NO: 1310 - DNA, 501 bp, Homo sapiens
agacagagctctgggtcagcagagaaaaaagtcaatgagttaatatttgaatgcaccaagggaagggacaggcctctgtgtgacacagcgcccaataggccagggtggaagatatggatcatatagaagggaaatgaagagaaagtggagagcacaacatgcacgaagttgcaggaatgaatgtgcatgggagatttggggagcacgagccccagaaaggaaaactgtgtaaaggcctcaggaagagctttctgctggggaagtcagtttcatgtagtaaggccttgtgtggcaggcagaaaactttggactgtattctatgacattataggaagacttcaagagactgtaacttgggaagagacttgactagagctgttttagaagataacaggggtgggccatgcctgtaatcccagcactttgggaggccaaggtgggagggtcgcttgagccgaggagctcaagaccagcctgggcaacaaagggagaccccatttc

SEQ ID NO: 1311 - DNA, 473 bp, Homo sapiens
gcaggagagagaactaagaacagagagcatgttctgagatgtctgctgtgtttgcaggtaacttccctcaatttccctactcattggccatgctagaaagcaggtcttggcgccatatttgtaccatggtacttcccctccctatactcaattggttggccagaagcccaattgtcattctctctctctctctctccctctccctctctccctctccctccctccctctccaagatatccagtaactgactgatcagctggtggtgggttctgctggctgccatgatgggccaccagcaaaaagggaaaattggttgtgagtgagagaagcagagataagaaaggccacagggctgaaaagaaagaccatgggctgccgggcgctgtggctcaagcttgtaatcccagcactttgggaggccaagacgggcggatcatgaggtcaggagatcgagaccatcctggctcacacg

SEQ ID NO: 1312 - DNA, 827 bp, Homo sapiens
taggagcatgccttactggggtttattggagttaatggttcctcagagaacataaataaaagaaggtctatctatggcttcctaaaggtaatggagagaaaagtaagttgaagaatggtgggaaatgtatgcttgactcaaaacagccaggatcatcatcacgttgaatccaagcatagttgtgctagatcatctgatttttccaaaaatctgggtttttatgtgaaatttcccaatttttaaattacttcattttaaaaatcacaagttaaaagaaaaaaacctacaggctgaaaatggccatcaggctgccaaattgcaagcttttttttactatacttaccagcagcaaaagaaacctatttttccccatttactctatgttcttggggaagatggtgaaaaaactatcccattaattcatcagagaaaaggtattattgcatttacaacataaacttaatgcattcagatttactctgtatgttttcagtttactctgggaaacctaccacactcctcttataccacaccctaactgtgaagttggtctatccaagcagggttccccatttgttgggcctcagtcttctacactatactacaaagcaagaggaatacaaaagaagtttcagcatcttaatttacaacctccagtggtttaaaccagaaagttcttttggagcaaaactactatgtcttttcttcctcagagttgctgagaaattataattagaggttttcctgttgtgtaaaggaaaggaattcctttcctttcctgtgtgtacaagacttctgttctcaataaatgtgcttccctgtccaaa

SEQ ID NO: 1313 - DNA, 268 bp, Homo sapiens
ttttagattacaactaaatatgttacagatttaaataacattatacaatggaattattttaaacacttatttttattgatgtgctttcataatttgactaatgataatcaatggtatgatatttgatcttacttcccctaattatgccattcatttgtgctgacaatatcctatgaatacagtatagtaaatgtttattatctatttgaaatttgggaaggagttcatgtatatatttacaaaaacaataataaagccattatttttc

SEQ ID NO: 1314 - DNA, 841 bp, Homo sapiens
gcgctcaattctaccagcaaatactatttattcaacaaatatttaacaagtgcctaccctatgtaaggcactgaactagatattagtgacacaaaaataaattttagaagaggcaataatttagttgaagagtgaaccccagatttacgtaatatagtttgttacatctatctaatctatatttatatagatctatatagatatgttattttttttttttaagacagggtctcattcctgttgctcaggctggagtacagtggcatgatcttggctcactgcagcttcgacctcccgggctcaggtgattctcccacctcagcctcccaagcaactggaactacccagctagtcctaccatgaccggttagttttttgtatttttaatagagacatggtttcaccacattgcccaggctagtcctgaactcccggactcaagcagtccacccacctaggcctcctaaagtgctagaattacaggcgtgagccactgtgcccagcctgttacatctacattagatatatacatatataattatttatatattttatatatgtaattatttcctaatgaaataacagacaacatggtaatcaaacaaggaaagaaagaagtatatgtgaaagtataaaaaccctcagaaaacacatcagatgagtcagtaaaactagttgtgaatagtcacacatgcctgtaatcccagctacttggaaggctgaggtaggaggattgcttgagctcaggagtttgagaccagcctgggcaacacgcatgacaccatctcaagaaaaaaaaaattgttgtggaataccagattaataaatactactttttaag

SEQ ID NO: 1315 - DNA, 385 bp, Homo sapiens
atatatagtttttatatgtagcatttgtctagtttaaaatcctttctaatttttattctaatcaacagattgtagaagattaaataggtaccaggagacatgaaagaatcatcttcaacatttctcaagtagctgctgattatctccttttatggaggcataacaagctcctggaggcttctacagattctaaagggaaagatttcctgggaggtgagaaagccacttgagagaaggctattttgatttactaattaattcagtgtaaaggtagtcctgggcacggtggctcacgcctataatcccagcagtttgagaggcctagacagaggttgctcaggagttccagagcagcctgagcaacttggtaaaaccctgtctctac

SEQ ID NO: 1316 - DNA, 495 bp, Homo sapiens
gtaacaattttttacttaaagtggattttgtctaactatggccaccccacccacttgagcttactgtttgcatggaatatatttttgtatcctgtcactttcagcctgtttgtctccttaaaactaaaatgagtcccctaaagacgcatattgtaagattttgtttttaactcattcagctattttacttttttaaagggttcaatctgttcatatttaaaataataccagaaagaaataaaattactagttgcgttttgttttcgattacgttctgtgcttgtcataaatacgttttccctcatttcctctcttactgcctttgtttttgttttgttaattttgtagtggcatactttgattcctttttcattttcttttgcatatcttctataggtatttttgtgatcaccttgaaaaatgagagtttatgaaacataacaatatgcttaaatctcatctttacttcagttgaatataaaactataccttttt

SEQ ID NO: 1317 - DNA, 548 bp, Homo sapiens
cagaaaacccatttgccaaaaattaacacctattcattatacaaactttctaaactagcaataaagggcaattttctcagcctggtaaagtgaatctgtgaaaaacccacagccaacatcatacttaatggttgagagcaaggcaaggttgtctgccctaaccacctttattcaacattgcactggcaacattactacaaggcagcaagaaaaataaaagactcacacgtttgagaagtagtaaaactgtctttatttctagatgatataactgtgtacctagaaatgcctaagaaatccacactattagaactaataaatttagaatagccagaggatatgaggtgagtgtatacaaagcaattatttatatatactagcaatatacaattggaaactgaagcagtactattcaatagagcatcaaaaagcaggtgggtgcactggcacgtgcatatagtcccagctacactaaaggctgaggtgaggggcttacttgagcccaggagttcaggtgcagctcaggcaacatagtgaaccccgtatct

SEQ ID NO: 1318 - DNA, 859 bp, Homo sapiens
caccagggccacaggaggagatgcagcgatgggccattcctagtgagacacagacacagggctggctggagaagaaaccttttgagctgtggggctgtcttcctagaagctgccaacccctggaaccactaagaggtcaaggctgaagtgtgccacttccacagtctgctaaggagtgcctccccctgagtcagggacaattcttgctctacttttcaggatccttgggcacactgctggcccgagacatttacttcccatttaaaattaagtaatcaaaataccagggtcgattactctgaactcttgcttatgtaaactttagggataaaactgtagtaagacacaaaatgctaacaataaaatataaattagactacattaaaactaagaccttcttttcattaaggacacagtagacttgaacaccaccattaagcaacttagcttgatttacacttgtagaacaccccattcacgagtagcatagaaacagtcaccaaaataaagagcagaaatcaaacgaaaaagcaaaaatagaggaaaatcaatcaaaacctagtttttcgaagagatcaataaaactatcagtcttgcaataagcttatcaaagaaaaaagggaagagaaatgaccaatgtcaggaatgaaaaagtgtatcaccacaaacccttcaagatattccaacaataataataaataatactatgtacatctttatgtacctaaattcaatcaattggatgaaataaaccaattgcttgaaaaccaaaaactaccaaaactcactgaagattaaatagataagctgaagttgaaacccttccaaaaaaggcagtttctgaagccagatgatttca

SEQ ID NO: 1319 - DNA, 884 bp, Homo sapiens
caccagggccacaggaggagatgcagcgatgggccattcctagtgagacacagacacagggctggctggagaagaaaccttttgagctgtggggctgtcttcctagaagctgccaacccctggaaccactaagaggtcaaggctgaagtgtgccacttccacagtctgctaaggagtgcctccccctgagtcagggacaattcttgctctacttttcaggatccttgggcacactgctggcccgagacatttacttcccatttaaaattaagtaatcaaaataccagggtcgattgatatttgcaataacaacaaaaattactctgaactcttgcttatgtaaactttagggataaaactgtagtaagacacaaaatgctaacaataaaatataaattagactacattaaaactaagaccttcttttcattaaggacacagtagacttgaacaccaccattaagcaacttagcttgatttacacttgtagaacaccccattcacgagtagcatagaaacagtcaccaaaataaagagcagaaatcaaacgaaaaagcaaaaatagaggaaaatcaatcaaaacctagtttttcgaagagatcaataaaactatcagtcttgcaataagcttatcaaagaaaaaagggaagagaaatgaccaatgtcaggaatgaaaaagtgtatcaccacaaacccttcaagatattccaacaataataataaataatactatgtacatctttatgtacctaaattcaatcaattggatgaaataaaccaattgcttgaaaaccaaaaactaccaaaactcactgaagattaaatagataagctgaagttgaaacccttccaaaaaaggcagtttctgaagccagatgatttca

SEQ ID NO: 1320 - DNA, 558 bp, Homo sapiens
ctggctggtttgtctaaaaccttctccaaagtggtgcttcctggaggggggtgcccatcgaaggggtgggcaggcagtgagtggcctggactcccaggtcagcatctgtatcgcactgcagtttatctgtaaagttcctgaacctgagccaaaggtggctcaccaccagcctcagagcggctgctggcaccatgcatggtagcaggcggggtccaggcagtacggctgcgctccccaacaccgccagctggttgctggggccgggcgccagtttctccagaggctgccacagtgaaggcccctgtcccactgcagcgaacagcaccctgtgccgcccggcctggggaccgtccttcagcctctcagacgccatgggcttgagatgaacgtcccttccagacagcagcgtgggtcccctcatctgaattcctggcagccttcaaacaagtgactccccacactccccttataaatctttgtaatggtatttacttctaggagaaaaagccgatcaatagcagagctttttaataattaaaagtgtgtacttctgtaatc

SEQ ID NO: 1321 - DNA, 547 bp, Homo sapiens
ctggctggtttgtctaaaaccttctccaaagtggtgcttcctggaggggggtgcccatcgaaggggtgggcaggcagtgagtggcctggactcccaggtcagcatctgtatcgcactgcagtttatctgtaaagttcctgaacctgagccaaaggtggctcaccaccagcctcagagcggctgctggcaccatgcatggtagcaggcggggtccaggcagtacggctgcgctccccaacaccgccagctggttgctggggccgggcgccagtttctccagaggctgccacagtgaaggcccctgtcccactgcagcgaacagcaccctgtgccgcccggcctggggaccgtccttcagcctctcagacgccatgggcttgtatgaccctttcctcccttcctccgcctggtccccccactccagtttccctgccctccccctgctgttttccctctgtctccttctctctatttctttgtaatggtatttacttctaggagaaaaagccgttctatggcgggctttctagtcttaatggtgtgtcct

SEQ ID NO: 1322 - DNA, 452 bp, Homo sapiens
ttttctcagtataaagggtaaacgcatatctctttgccccaaatttcaccaaccttggcctgtacagatgtgtgtttttttttttaaattcccctactaaccagccatttatttgggttaaattctgtagacacaaatcaggtgatcatttagctcttatcagtgggtgtcatttagcgtttcagcctaagtagtcatccatctatcaaagaaatagaaaacagatgggaagcaaggatgctggggaagataggaagactgagcagctgcttctcagggtggtttgacctacagagtgcatgaggtgcggtaggggtaccaagggggtgaggctctgggtagccatttggaaatgtgattctcctggatggtgtgtgcggaatagaaaaagtcacagagcctgagatcaaggaacactgtggataaatgtcaacatgtgttcctgtttggtt

SEQ ID NO: 1323 - DNA, 385 bp, Homo sapiens
  misc_feature (325)..(325): n is a, c, g, or t
cagcccctgccctgcaccaagcagaggggctggacacctctgtcatggcaccagctgcctctccttccccagcacagtctggacctgggcggactttttggaaaagcttctggatgccacggactccacgaccaaccaactaggttgctgctgcttgcaaacatcgcctccattgaaggattcctgcagccaccagctctggaactttctggaaccaaacatttccccagactgcctacaaggaccaattgggcctctggatgtaggtgtggcctgcaggggtccggcagggcttccccagagtcaagtgggacccagccctttnggaccccctgcccggtcctattgacctctgctctctccctgcagcacttcctggaggcgt

SEQ ID NO: 1324 - DNA, 397 bp, Homo sapiens
actagaggatgtagtttagacccacaggtaagtgggctccttaacactaacctcagaattagagacatttcccaccaacatagagtaagaaaacacaggtctccccagtgcgaccagcctcactttgtggcctgataacgctttttgtaggaaggtcatccccaaggagaaaaagggaagagaaagggagtgttgtcatatatggacagatcgtttttcttacaaacatataaatcagattgggccactggttaacactgagtgagagaaggagagaggcctggattgttccatatgaaaaaaaaaatcaagagtggaaaataattcctgccacctccatcttcaactatatattttatttttaaattggataaatggccagtgtaagatgaaaacc

SEQ ID NO: 1325 - DNA, 1151 bp, Homo sapiens
ggaggaaggcacagaccttcctcctcctggaacatccaagggcactggatcctctgtgtccctctgagatggggtgccactccagcaagagcaccacggtggcagctgagtcccagaagcttgaagaagagcgcgagggaagagagccaggtctggagaccggcacccaggcagcagactgcaaggatgccccgctgaaggatggaacccctgagccaaagagctgaaatgcctctctccagagtcggaccctcacctccttcctggaactgcctttggccccagaaccatgagacaatccccaccctgagaagctccgatcactgggaggagagagaaagcctccagctttgggattcaggcttcagaagtttttagcagcctttgctcattggagaggtggggaggataagtctataaggaatcctatttccccagctctcccacagagaggacaaaagaagtcttcacacgttgtggaactttcctgcaacttctggatgcagacaagcctcagagcagactgttctggctccagtgaatatcggctgccaagctgtgagcatccagggatccccgtctgcctggctttcctgaagtcagaaggcgccttggtcatactgtgtggggtgtgtggatctcagtttgctctctttctttctccttttttcaacagctggcggagtagccaacacccctgacagcaatgtgttgcacttggctcactccacaccctatgaataattttaatatttaacttgaaatgttgttaagaaactatggaaaatatcaggatcccactgggatcccgtaaattgaaggcaacaaggtcttggtcctccagtaaggggggcatggagccctggtgggaaggaaagaagagaaatttgtgttcctgattccttaatccccaagaaaggtccctctgctaacattcacatatctcttcctagccaaagtctgtccatttcaaccctctagcatctgagctatctgcatccagctttcaaaaatatttcgctgtttactaacatgtctgtcagcctctcttttctcccccgcatgtgttttgtttttaaatccactcaaaagcgttttcatttgaaatcaaatagacatgtttgcaaataaatgttgacacaacaaagaaa

SEQ ID NO: 1326 - DNA, 720 bp, Homo sapiens
caaaggacccttctttttggccataaaaacctgagaaactgattgagattcttttgagcaataaggcaactgcggtgaggaaaaaataaggaaggaggcacaaaaagcaaagcagttcagcctgaaattgactacagagcttccctttgcttcagcagagcctggaggagcaggagggatgggggccctgtcagctggcccaaagccctgccctgtcccaggggtgctaagcttgctgcaggccaggaaacaggcctgggcttgcagctggggatcaggaagtttggggcctctttgcacagcttactggggataggccaagctctgggaactcctttcaattttttttttttttaagacaactctgtttttctccctcctccctactagtggaaatttaccttgcaaaacaggactgtgcatggtgagagctgcttgcaatgtccacactcaggactctatggaaagagttcgcagctggtggtgaggctttgaggtggggctgcccttatttcactagctcctgaggggcagagctcactcagctttttaccaaatcaaaggaaggaagctttaggtccttcgaagttcagaaccagggtggtttgttttgcttccttttggaatggaataaaatgctcatttaattaaaaacacaaaaaccccgggtcctttttcgggggcggaaaagggttggaatggccatggcaaacggtcccg

SEQ ID NO: 1327 - DNA, 600 bp, Homo sapiens
ggaggaaggcacagaccttcctcctcctggaacatccaagggcactggatcctctgtgtccctctgagatggggtgccactccagcaagagcaccacggtggcagctgagtcccagaagcttgaagaagagcgcgagggaagagagccaggtctggagaccggcacccaggcagcagactgcaaggatgccccgctgaaggatggaacccctgagccaaagagctgaaatgcctctctccagagtcggaccctcacctcctccctactagtggaaatttaccttgcaaaacaggactgtgcatggtgagagctgcttgcaatgtccacactcaggactctatggaaagagttcgcagctggtggtgaggctttgaggtggggctgcccttatttcactagctcctgaggggcagagctcactcagctttttaccaaatcaaaggaaggaagctttaggtccttcgaagttcagaaccagggtggtttgttttgcttccttttggaatggaataaaatgctcatttaattaaaaacacaaaaaccccgggtcctttttcgggggcggaaaagggttggaatggccatggcaaacggtcccg

SEQ ID NO: 1328 - DNA, 344 bp, Homo sapiens
gggttttcagagaccaggttcctcctctgaaacctcagcctgtggctctctgtgccttcatccccgcagctggcatggaaataatgatctgacctcccaggggaggcggccccacgggcgtgatggtgacaccctgtggggggcagcctgggtaacatgcagagtgccgaggggtaggcctgagctcaaatctggcttctgccctcaccgagccatgtgatcccatcctggctactcccatacctgagctggagtttcttcagcagtaggaccagggtgccgaggggacaacagaactccctctgatgagggatcaccctgcagcctcaagaggctcaaatgca

SEQ ID NO: 1329 - DNA, 225 bp, Homo sapiens
ctaagcggggtcatggacagtctcccagctcccctgcaccaatcagtggttccacatcagacttttctgcctcacatttttttttcctttttaaaggtacagttaagggccaggcatggtggctcatgcctataatcctaaccctttgggagacaaggcaggcaaatcatttgagcccaggagtttgagaccagccctggcaacatggcaaaaccccatctctct

SEQ ID NO: 1330 - DNA, 319 bp, Homo sapiens
ttttcttattgctgagttttaagagttctttttacagtttggataacagtcctttatcagatgtgtcttttgcaaacattttatcccagcctggggcttatgttctcatttttttgacttttttttttttaaatcagtcttgctagaggtttatcaatattattagtcttttcagagaaccaatctctgggtttgttgctatcctttttctactttttgagatgcgtacttagactgacttttagccttttttatgcaagttttgatgtcatttaaaaattgccatatagttccaaatattgtctaacatctactgcaa

SEQ ID NO: 1331 - DNA, 425 bp, Homo sapiens
caatatgtggccttttctttctggcttctttcatttagcatgttttcaaggttcatgtatattgtagcatgtattagtacttcattcctttgtaaatattttacctgaagtgttttctaaataaaaccttttaaaaagtgatagtgctgaagggaagcaaggtagaatttttaggagataggtaatctgtattggctctcataaaactagtcacatgtgaagcctgcattgctttagaacagggatttccaaccttttggcttccctgggccacagtggaataagaattgtctcatggctgggcatggtggctcacgcctgtaatcccagccctttgggaggctgaggtgggagaattgcttcaacctgggaagcagaggctgcagtgagccgagatcgtgccactgcactccagtctgggcgac

SEQ ID NO: 1332 - DNA, 270 bp, Homo sapiens
cctattcaagcagaatctgttggggtgggtcctggagcccagatatcttactaatctgttcagcagagtctttgtgtacaagctttgagaggcagtagtctagaacagatttctgccccagcccaccccaccccacaattgcccaagctggagtgcagtggcataatcacgcctcactgcagcatccaactcttgggctgaagcaatcctcccacttcagcctcccaagtagctgggaccacaggcatgtaccacaatgcccagctaatt

SEQ ID NO: 1333 - DNA, 400 bp, Homo sapiens
tcacaaagaccttgctgattgataaaagtctgtggtaaagaagttggccaaatcccaccataaccaagatggtgacgagtgacctctggtcatcctcattgctcattatatactaattataatgtattagcatgctaaaagacactcccaccagcacggtgacagtttacaacttctggaagttaccctttatggtctaaagtggggagggaccctcagtcccaagaaatccatgcccctttcctggaaaactcatgaataatccatcccttgtttaccatataatcaaggaacaactataagtatactcagtcgagcagcccatgccgctgttctgcctatgaagtagacttttttttccattactttcctaataaacagacttttgactttactctat

SEQ ID NO: 1334 - DNA, 441 bp, Homo sapiens
ataaatactccccaaactaacaccttacaggcaatggtagaaaagaaaaattcacaactgttgtattctggtaacatgcctgctttacccagtgtacccactcaatgtcttctctaatttctactgtgtaaacttctgtctctggggtttccctcaccaactaagcatcttgtgccttctttgtcctttgatatttcactgttattctttgagcacttcctttcctgcacaataagatatattagactcatctagtactttctctgcctcagtcaattctccaaggagccttggttcctttcaatggaaaatgcagtatttagaaaccaagagtaggccctgttggggctcattgcaattgggtgggagtgatcactgcatccagtactcttctcattctgtttgggtagcttccatttctaattcaattgaagtgactta

SEQ ID NO: 1335 - DNA, 563 bp, Homo sapiens
agagaccaggaaaagtgtttttctcctcacttgttttaatagggaaatgaaaacatggcttaaattttttctagttgaacctattgtaagctaaacagactttgcaggtcttcatagctgcacactctgaactcgaagatttaacttgaggctaaaattctatttttgtttcttctctcctttggtaacaaagagctgctatgtgaggtggggatgcccaaggcctcctgtcacttgtcctaaaacaggcagaggcagctggcatcagaagagtggtcagctacatggagggcattgtgcagatggagcacatgaaagtctatgcaccatcagtgtgtgggttcttggagactggcgtcagtcttgctgtagagtagacgtgaaaatggaaactggcccatgtgcccatgacctcctgaaaattgggatatggaggatagagaaaacgttagacagttatgaagagcaatattctgtgtccttatcatttaaccatctattctttcattttaggagaaaagtgagtatatttaatataaagagtcttggcattataagcctat

SEQ ID NO: 1336 - DNA, 289 bp, Homo sapiens
ggatatacggctggcatttaggctaagagaggaagggctgtaatggggtgaagctaaacacataagtatagcccagatcacaaagagcctaggattctaggctaaggcactgactggggttttatccagaaggtaatggagagtcactgcagggctttttaaaacaggaaataggcatggtcagatatgcattttagaaacactcttctgactgtagggtgaacactcgattgaggcaagttagagcggaggaaaggaaggacgctttgttagagtagtcctgtacagc

SEQ ID NO: 1337 - DNA, 433 bp, Homo sapiens
agtaatatatgacatacactcttaaaaaggaatgactgattcagtgagaacatttgattgttttccacagaaggcaaccattaaagctggacaaaactgtcaaaacaactgtttgagtactttaccaaacaaactgagaagctttattcatgaaaactaatgaacatagggtaagaatagcacaaattcgtgatctggtgctactccttttctccttttccttgtccctagctctgtcgcatagcatttcagtcaggatgaaaaccagcagctttgcttccacttttgcagagaaatcacttgctatggagaattgtaggttaaaatagtgatctttgtggcaagtaaacagagagggccaacagctttattagtctaagactgtagtccaatttggggccagcagtaggctcatgaactagttgagtttaat

SEQ ID NO: 1338 - DNA, 337 bp, Homo sapiens
tgcccaagatctcactgcttgttaaaggtggtctcaaccccgtctgtcttctaagcttcccactaccccatgtctgagagcaaaaagccctctttgcaacctgagatcacactcaagatggaagactgtcaagcccatccctgccagattctattaatgtggtcctaatgggccacaccagcaaaaacaagctgcgttgtattcctttgaagaaaactaagtctgcctcagaaactagcagaccctgtaatcttcagcggtattattaaaaagcacacctgcctcaaagcccctggttcatccatggaagcatcgcagaagcctctgtattaggggc

SEQ ID NO: 1339 - DNA, 848 bp, Homo sapiens
ttaaatatcttctcccactctgtggcttttcttttcactataatattaaagttttgtttgttttcaatgaacaagacttgttaattttactacagtacaatacaccaacatttttggttggtgccgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaaactcataaatttccattatacattattttattcatgaattacttagatgttttttggagggtagttttttgctattgatttctaatattatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcaaatattttctaccattactagtgtttgacagtttctgatggagatgtgacagcacttcccactcttttggatatataaagcaaagatggcagtgtttgggcagtgcagtctttcagcatctgctggctgtgggtgggaataagggagggaagagaattaattctatttggaagcattatatc

SEQ ID NO: 1340 - DNA, 408 bp, Homo sapiens
ttgtatagtgtctggtatacagagggcactcctatgcatttttaaaacatgctgagcacatacccatgtgcccaggctttgtgttttatcctaatgttatcctaatggtattggtgcccattatgtaatgttgccctttacaacaacctcatgagggagatttccatctttacaaataggcaaactgaggcccagagagattgaggaactgctccgaggtctgattctggaatgtgcttcctttccactttatcaatctgctcttcgtactcctgtctgaacgatggaaattaatttttgaatgtataaaagacaacagactatgatacagaaatgtcagccccagcccactaagaaagccccagcccatcagtggctaatggctttaataaattggtcatttggcta

SEQ ID NO: 1341 - DNA, 450 bp, Homo sapiens
ttttattaattatttccaagctgataccccaggtactctgaaaagactgttatttcttcctcctttgcttattaactttaaatcatagtttcttcacttacatctgtctctttttcatttgtacatgctgccaagtattaattatcatttttaaagattggaaaaagaggaagttttcttgcacagaatgatgacccacgcttgaaaagtcatatagatacaaacacacggcacaagaaataaaaaactataccttatgaaagtcctcagccaaaccataagcatagaaagaagacatttaataccaagtatactatgaaaaagagccaatgcacagctttcagaactttaattattgcctgtgtcaggaaaaaataactgtttccagcacactgtgtacctactaaagattctagatgaaatcagatatataggcatttctctggtagt

SEQ ID NO: 1342 - DNA, 385 bp, Homo sapiens
gggatgcctctggaagtaaaatcacagcagaaggcgaaggagcagcaggcacctcacatcgccagagcagaagcaagagagagtgggtgccacacttttaaacagctagatctcaccaggactcattcactattgtgaggacagtaccaaggggatgatgtaaaactattaaagagaaatccactcccatgattcaatcacctatcaccaggccccacttccaacattgaggattataattcaacatgagatttgggcagggaaacacatccaaaccatatcgtgtgagtacctaaaatatgagtattttttctttgcaggctctcaggttaaataataaataaaaatttgttgagcttctattacataacagatattattgcat

SEQ ID NO: 1343 - DNA, 537 bp, Homo sapiens
tttttttttaggagacagggtctcgctctgtcacccaggctggagtgcagtggcatgacaatagttcactgcagcttcaaactcctggcccaagcgatccatgtcagcttcctgaatagctgagactacaggtgtgtaccaccacacccaggtaattttttaagttttttatagagacagaatcttgctttatctctcaggccagttttgaacttctggctttaaacaatcctcctacctcagcctcccaaagtgttgggattataggcgtgagccactgcacccaatctactattttttaaatgacatcagcactttaatttttccatttgctctacttttaaaaataaggggaaaatgcaataaagtattctataattgcacaaatgcttttttacaaagatacctaagctgctgaaactgtagtgctaccaggcaataggtcctgttgttcacctgttacctgatattttttaaaaacctaaaattaatccaaaggtcgacgcggccgcgaatttagtagtagtaggcggccgc

SEQ ID NO: 1344 - DNA, 587 bp, Homo sapiens
attgtgcttacatccttaaatcgatccttacatccctgtgataattggcggagtttcagttgatctacttacaaagcccttggttgggatttttcatttccactcccattgtcttaagaatacaaaagaaatagggagctatcctaaagaaaattagcaatcagatgtggagccaaattatacagaaaaaaaaaattgtttagactagttaggaagtacactgtcaaggataaacttaataaagggctaatcagttgtatacattttgaaggaagaaagagaaacactggtgtggaagagaacatcctgggtggataagattatacttgcaaagggaagaatgcgaaagtcattctcaacagtccataagtggctcatctttttttttttgagactgagtcttgctctgtgtcccaggctggagtggcacaatctcggctcagtacaatctccacctcccaggtttaagcactacttgggaggccaaggcagagaattgcttgaatctgggaggtggaggttgcagtgagccgagatcgtgccactgcactccagcctggatgacagaatgagattccatctcaaaa

SEQ ID NO: 1345 - DNA, 483 bp, Homo sapiens
tctatggagtgaggtgaggtatggattcaagttcactttatggatatggacagccaattgttccaacaccgcatgttgaaaaggctatcctttctccactgcattgccatcctgcctttgtcagtcataagctggttgcttatgtgttatctatttctggactgtctgttgaattttattaatttgcaggtgctccccaaattgtgggaaacccagtgtttgagtcaaaagcaatttaatacttcagtaaacccactgtaaagtcagtaagtcaaaccaccttaagttggggattgtctgaatttgactttctttatacaggttgagcattgctgatttaaatatcccaaatctgaaatgctctaaaaccccagactttttgattgccaacatagacagcacagtggaaaaattctacatccgacctcatgtatacaaacattgtttcatgccccaaattattaaaagtattatttaaaatta

SEQ ID NO: 1346 - DNA, 379 bp, Homo sapiens
tattttcagctttcccggctacatataatctttgttgcatattcatttttttaaacaatcatttaaaaatggaaaaaccattctgagcttgagggctgtataaaaacaggctgtaggctggacttggcatacaggctacactgcctgctgattcctagattttgaattattggagctatatacagtaaaggcaggaaccagacaaagcaatcaacaggacaattcctccaattatcaagtttttaatagcttttagttttaagttctgataagcacaagtggatttatactcattaactttcttaaagctattgcttaaaatcaaattttgatctaaatcaggaattctagagagaactctgaagatagaagtacataa

SEQ ID NO: 1347 - DNA, 205 bp, Homo sapiens
gaaagccgcgtgggcagtgagtatctggtatctttgctgaggctgcctcaatagcaaggaaaggaagcagctgtagtaggaggtggggtgccctctagtggtcatgctttggttgctgtcctttctcaagctcttacatcccttgacatcctctgagttgcttgaacatttcctacaacatctcatggtaagaaatacattttgc

SEQ ID NO: 1348 - DNA, 456 bp, Homo sapiens
gctttgctggtgctgttgagatgtctgaagacattctgatcgccagttctttgtgtgtgtgtcttctcttttcctctctggaatctttagtgaagctgtagagggcggtgtgcaggcctggctaccgtggtctgggagttgagtggggagtcttggagtttccactttcactcacaccctctcccaaacactgccctgccttcagctgggcctgagtgccccgtacagcatctcctggttcatttctccagatgtagggttgcctactgataaaacaaaagacccccggttgaatttgaatttcagataagcaacaaagaaagttttagaataagtatgtcccattgcaacatttgggatatacttttactaaaaaaagaaattgttgtttatctgaaattcagatttagttgggcatcctgtttttttttttttttgttttttgttttttgtttt

SEQ ID NO: 1349 - DNA, 379 bp, Homo sapiens
tcatggccctggtgggagtgtagcagtgaggatgatcagagatcactctcatggtcatcttggttttgttcctcagaaaattaaatgtcagaagaccaagaagctcaagaggatgaattgctggccccagtgagtatttacgatggagatgaatttagaaaagcagtctgtccaaggtggagaaaccaggatctatttggatttgccatagaatttcaagatgtttgtgagcgctatctgctctatgggaagaacaccctggcagcgtgatcccgtttgcctggatgcaatttcttaaggaagagaccctagtatacctgaatattgtctctccttttgagctcaagattgattctcagaaaaaaagtgcagagaagga

SEQ ID NO: 1350 - DNA, 840 bp, Homo sapiens
gcactacctgtctgcgggaaagcgggatccaccccaggacgtcgggtcgctgccgacataatgtcaagtggaaactatcagcagtcagaggctcttagcaaacccactttcagtgaggaacaagcctctgcgttagtggagtcagtgtttgggttgaaagtttccaaggtccggccacttcctagctatgatgaccaaaactttcatgtctacgtttcaaaaaccaaagatggcccaactgaatatgtcctcaaaataagcaacaccaaggctagcaaaaatccagacctgattgaagtgcagaatcacatcatcatgtttctgaaagccgctggatttccaacagcctctgtgtgtcacactaaaggagacaacacagcttctctcgtgtctgtagatagtggctctgaaatcaaaagctacttggtgaggctgctgacttacctcccaggaagacccatcgctgagcttcccgtcagcccccagctattgtatgaaattggaaaactagctgccaaattggataagacactgcagagattccatcacccaaagttaagtagtcttcatcgggagaacttcatctggaatctgaaaaatgttcctcttctggagaaatacctgtatgccctgggccagaatcgaaaccgagagattgttgagcatgtcattcatctgttcaaggaggaagtaatgaccaaattaagtcattttcgagaatgacctagcaccgtgccaggcccctagaagacccagtaaagatctgttgaataaactgtaagaatgaacacaccaaaaaaaaagtcgacgcggccgcgaatttagtagtagtaggcgacc

SEQ ID NO: 1351 - DNA, 404 bp, Homo sapiens
gcggccgtctactactactaaattggcggccgcgtcgacccaaggctagcaaaaatccagacctgattgaagtgcagaatcacatcatcatgtttctgaaagccgctggatttccaacagcctctgtgtgtcacactaaaggagacaacacagcttctctcgtgtctgtagatagtggctctgaaatcaaaagctacttggtgaggctgctgacttacctcccaggaagacccatcgctgagcttcccgtcagcccccagctattgtatgaaattggaaaactaggacctagcaccgtgccaggcccctagaagacccagtaaagatctgttgaataaactgtaagaatgaacacaccaaaaaaaaagtcgacgcggccgcgaatttagtagtagtaggcgacc

SEQ ID NO: 1352 - DNA, 426 bp, Homo sapiens
catcttctcttgccctcagatagcaaaactccaggttcttggccttcaaactccaggacttaaccagcggcccctcaggttcttaggtcctcagcctcagactgagttacaccatcatctcctctggttctcaagcctttagactcaaactgaaacacataattggcttcactggttcttcagcttacagacagcaattgtgggacttcctagcctccataatttatttccataataaatcccctcctgtttatctacctatccatccttccatcccattgattcggtttctctggaagaccctaatataatacataaattaaatatttattttactttactttcaggacctgacctagcaccgtgccaggcccctagaagacccagtaaagatctgttgaataaactgtaagaatgaacacacca

SEQ ID NO: 1353 - DNA, 978 bp, Homo sapiens
ccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggagatggaggaggacatctggacagtgagcaggaggcgcctcggcccatgccgaacatcccaggggacctggagagccgggaggccatggtggcatttttcaactccgctggagccagtgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcagcgactttatggaaggagaaggtggacctgaaggagcgggtagagaaactagagcttcaattcatccacctctcaggacagacagacaccatagaaagtacatcagccagggggcagtgtcagagacgcagcactgggagaggaggacatcgtcaggctggcccaggaccaggaggagatgaaggtgaacctgcaggagctgcggggcaggtgttgcagcttgtgggcgaccacaaggaggggcatggcaaattttgaccattgcccagaaccctgctgatgagcccactctaggagccccagtagcccaggagcttgggtgtgctgacgagcagggtggcttttatcctagatcaccactggattgctgacagatagaggaggtgggaccctgactatcacccctaatctgcagtggatttggctctcggcactcccaggctgggagc

SEQ ID NO: 1354 - DNA, 1825 bp, Homo sapiens
ctttgttctttcctgaatgttcatgaccttgacatcttagaagattaaaggttatttaaagttgttgagttaaatatccattaaattaggtttgtcagatatttcctcgaaattagattcagcttatgcattttttggaaggaataccacagaagtgatgttgttttctttctgttgcatccaatcagatgatacaggattttgatttgttccattactgttgacatgaattttgaacatttgataatgccagtatcagccagatttttccattgtaaagtcattcctttgtcctttgtatttaataagtatgtttagggactttgagactatgtcaatgtcctgttcttcatcaaaattccactcactcattcttagtattcattgacgtttactgatcggactaattattattatgatagttgccaaatgtgggtttttctaattcaatcatttctttagtgtttattagcattctactataaggaaaagcactatcttctccccatttattaattcacatatttacatcagcttggagttattgatttctattttattaaatagtttataattgattaccatccttatttattttaatgctcaaattgtcccaaattatggccaaagaaagctccttcaaactggttgctatgtccttttgacatggcccatcattctttaaacacattttacatctggcacaataacgtgctacatacccatcttgtatttttcctgccccatcttttaaatcagccattctcaaggggttccttcttaatctggctgttgttgtgttggaactcctggtaccatcttagaaccttaaggagacaagcgaaccaagccaataagctttccatgatgctgcttagagttaaacagagcccaggtactaagttatgtcatggagacagtgaactaacctctggactgcttgctacatgagacaattgattttcttattttctatgtagggtggtacatttcctcattttgagatatttcttcaacatatagcttttcattagtggggattttgtcaattataaccaaaaacaatgtgacggatacccaagatgtttcatgttgtagcttgggtgaattacacatttctgaagccattacacttcctagtttatttggatttaagttgacaaataaaaattgcatatgtttatggtctataacatggtgtttcgatatatgtatacatcgtggaatggctaaatcaagctaacatatccattacctcacatagttattttttgtggtgagaacattttaaaaatattgtcttagcaattttcaatcaagcctgtcccatggagacacaagcaatagtgacatgagcacttgactcgctgggttatcaggctttggctccaaatgtttggcttcaaatatgaaaaaattacatgaaagatgaaactatgcaatggcatggctgttggtcattcacatctctctctgccaagaatggagatgacgctgttgaaggaagaaatgtgttttctcctttttctcaagtgatatttgccttaggtcagattctactagtttaaagcaaaacgatctcctggtctgattcctttgggtctctaataatggaaactgcaaggatcagcataaagtgttcctttgttctgacgttggtataacattgcttcttgaaaaatgaaagtatttggacatgcagacagaagcaatattattcaggtcttccttgttgcaagtgagggaaatccaattaaaactggtttaaaccagtagaatctgacctaaggcaaatgtcgacgcggccgcgaatttagtagtagta

SEQ ID NO: 1355 - DNA, 1806 bp, Homo sapiens
ctttgttctttcctgaatgttcatgaccttgacatcttagaagattaaaggttatttaaagttgttgagttaaatatccattaaattaggtttgtcagatatttcctcgaaattagattcagcttatgcattttttggaaggaataccacagaagtgatgttgttttctttctgttgcatccaatcagatgatacaggattttgatttgttccattactgttgacatgaattttgaacatttgataatgccagtatcagccagatttttccattgtaaagtcattcctttgtcctttgtatttaataagtatgtttagggactttgagactatgtcaatgtcctgttcttcatcaaaattccactcactcattcttagtattcattgacgtttactgatcggactaattattattatgatagttgccaaatgtgggtttttctaattcaatcatttctttagtgtttattagcattctactataaggaaaagcactatcttctccccatttattaattcacatatttacatcagcttggagttattgatttctattttattaaatagtttataattgattaccatccttatttattttaatgctcaaattgtcccaaattatggccaaagaaagctccttcaaactggttgctatgtccttttgacatggcccatcattctttaaacacattttacatctggcacaataacgtgctacatacccatcttgtatttttcctgccccatcttttaaatcagccattctcaaggggttccttcttaatctggctgttgttgtgttggaactcctggtaccatcttagaaccttaaggagacaagcgaaccaagccaataagctttccatgatgctgcttagagttaaacagagcccaggtactaagttatgtcatggagacagtgaactaacctctggactgcttgctacatgagacaattgattttcttattttctatgtagggtggtacatttcctcattttgagatatttcttcaacatatagcttttcattagtggggattttgtcaattataaccaaaaacaatgtgacggatacccaagatgtttcatgttgtagcttgggtgaattacacttcctagtttatttggatttaagttgacaaataaaaattgcatatgtttatggtctataacatggtgtttcgatatatgtatacatcgtggaatggctaaatcaagctaacatatccattacctcacatagttattttttgtggtgagaacattttaaaaatattgtcttagcaattttcaatcaagcctgtcccatggagacacaagcaatagtgacatgagcacttgactcgctgggttatcaggctttggctccaaatgtttggcttcaaatatgaaaaaattacatgaaagatgaaactatgcaatggcatggctgttggtcattcacatctctctctgccaagaatggagatgacgctgttgaaggaagaaatgtgttttctcctttttctcaagtgatatttgccttaggtcagattctactagtttaaagcaaaacgatctcctggtctgattcctttgggtctctaataatggaaactgcaaggatcagcataaagtgttcctttgttctgacgttggtataacattgcttcttgaaaaatgaaagtatttggacatgcagacagaagcaatattattcaggtcttccttgttgcaagtgagggaaatccaattaaaactggtttaaaccagtagaatctgacctaaggcaaatgtcgacgcggccgcgaatttagtagtagta

SEQ ID NO: 1356 - DNA, 433 bp, Homo sapiens
ttttttttgacagagacttgtgctgtctcaaagcccaggctggagtatagtggcacaatcttagctcactgtaacctcaaactcctgggctcaagtgatcctcttgcctcagcctcctgattaggtggaactataggcatacaccaccatgccgggctagttttttattttttgtagagatggggtctggccctgttgcccaagctggtcttcagctcctggcctcaagtgatcctcccatctcagcctcacagtgttggggttacaggcatgagccactgcgcctggcctttgatttttttattaatagaaaaacaatgaataatgaaagaaaatggaattatcatagaatcatagaagtaaaaatagatcactgtcatgaatacttattcagttttgatatttattactgataatcacataccaccttatg

SEQ ID NO: 1357 - DNA, 495 bp, Homo sapiens
cccccatgatttagttatatcacactgggttcctcccacaacacatgggaattatgggagctacaattcaagatgagatttgggcaggggcacagccaaaccatatcagtcataaaagataaaaagactaaggaagtgttctgattacaggagactaaaaagatatgacaactaaatacaacgtgtgatcctggattggattctgaaccagataagggacaagaataaagtctgtgtattaaatatcagtgttgtatcagagttaacttcctgaatttgataaaatttggaatgatctctcctcactaccttcccacactcctctccagggcctctgcatgtgggcatctgggccctcctctgttaacacccctcttctgtctggactgcccctcacttcatctttcccccatgcacggtctttcctaactgtccttatgtaagagaatgactttggttttaagaaattcacactgaaatatttagaggattaaa

SEQ ID NO: 1358 - DNA, 312 bp, Homo sapiens
gccctaaggaagccagcaagaaaatgaggacattagtctataaccacaaggaaatgagttctgctagcaacctaagggagcttgaaggtgattgaccatccccagtcaagcctctgatgagaccgcagccccactaggcaactagatttcagcatggtaagaccctgggatggagaacccagctcagccatgcccagactcctatcctatggaagctttaagataataaatgtatgtgggctttaagctgttaagcttttgggtaatttgttagatgggcaacagaaaatgtgttacaccctgggatagtag

SEQ ID NO: 1359 - DNA, 206 bp, Homo sapiens
tgccatgtcagagaaggaactagattccagaaaacagaaggtagttctcttttaacttactgcctaatgctagtgtcagaaccacagtaaagccagcaacatttgagaccaaacccgaggacagtcctcaggattttacaggtgaggggcctcggcttcagggaagtggcttgtgaaacacctttttgagggaccattatgtaata

SEQ ID NO: 1360 - DNA, 461 bp, Homo sapiens
tcaggcattcgctcccactgctctactggtgcccttcatccaggtcaccaatggcctccacatggcaagatccatggtcaagtctcagtccttgtcctactgggcttggcacagttgactgcccttgctttgtttgatttcaggcctcatgctctcttggttttcctactacctcactggtctcaccgtctgtcttttctctcctctccccaacctcttaatgttgggatgacccgaggctcagttctccatcctcttctcttatccatctgtgctcactctcttggtaatttcacccagtctcattgcttgcaatatcatttacatgtggctctcacatttacgtctctagcctcgtcctctcacttgaattctgactaataatacaattgtttttatttttattgtttttttgagacggagtctcattctgtcgcccaggctggagtgcaatggcacaa

SEQ ID NO: 1361 - DNA, 571 bp, Homo sapiens
aaaacccagtcatgtagattttctcctatgttatcttctaggagttttatagatttgcatttaacattcagctctatgatccattttgagttaatttttgtgaagagactaaggtctgtgtatagatttgatttgatttatttatttttggcatgttgatgtccagttgttctagcaccatttgtggagagaagtttggaagtttgagcattttttatgatacctttttttttttttcagacggagtctcactgtcatgcaggctggagtgcagtggcacagtctcgactcactgcagcctacacctcccgggttcaggcagttctactgcctcagcctcccaagtagctgggattacaggcgtgcaccaccacacccagctcctttttgcatttttagtagagacagggtttcactatattggctaggctggtctcaaactcctgacctcgggatctgcctgccttggcctcccaaagtgctgggattacaggtgtgagccaccacgcccagccttatgatactgttctatctctgctctgtgcccaccaccacacccagctaatttttg

SEQ ID NO: 1362 - DNA, 411 bp, Homo sapiens
gtgatgcagggtggttttcagatagactaggtttttattttgcctctatactggacaggttgagtgaccacagagctttatatcttagtgactagtggttaaagagattgcatttgcattatcctaagtgaattagcacaggaacagaaaacctaccactgtgtgttttcacttataagtcggagctaaacatttgatacacacgaacataaatatggcaacaatagacactggggactgctggagaggggaagaggggaggagagtaaagattgaaaatgaactgttaggtactatgcttactacctagaggatgggattaatcatacccccaatctcagcattgtgcaatatactcatgtaacaaacctacacatgtcccctctgaatctaaaataaaagttgaaatta

SEQ ID NO: 1363 - DNA, 458 bp, Homo sapiens
attcatctcagacgttgcgttttttttccccttgctctgacctacttgcccctctcttcctcttgaggacaccccattcggtaagtcacttgcacaggaatctattccagtatcagctttcaaggaaggacgtcagcttcagtcagtattaagatagcagcattcaaactatctccaggaaaatatctggcagggcaaacaagtatgggcacaggatacggtggaccaagcacgcaagttgccctaagagattcaagtatcaggctgagtgcagtgactcacgcctgtaatcctaacactgagaggctgaggctggtagactacttgaaccctggagttttgaaccaacctgagtaacatagcaagactttgtctcccccctcataaaaaatcaagatctgccctgtctagttatgcgaccttgagcaagtgacttcacttgattcctttaaaaaaaa

SEQ ID NO: 1364 - DNA, 742 bp, Homo sapiens
gagtttgttagaagcacacctttaactcagaattgaggttgactgataaaactcagctttaagtaaccctctgggcaagttctgagcagagatccagtgagctgaatgtcaggcaccacctccctggagtctgtatcagtcacatcagcattctcctctgattagaatcaggtttcaagggtcttgttcaagagtttattctctcctttaaagatgccacaatacgtataaggaatgtctcttggtcccaactaatctacaataagagaggagcagtatagtcagaggccagaaaacaacgcagtttctagttcaggttatattctcttggaacagactccttgctgaggggcttctagaaaaggaatgcaatggtccacctctttctaagtaggaggggaagaaggggcttgtattggtggatataactcctttcctatcctctcaactgtctaatccccaagtgacaaccatcctctccttctgttgtactttctagcttaagataatcacatatatcacacacaccaatgaagtgctatcagttggaaagggtggagacagaaccagaagatgggaaggaaaaggccttgaacacagcctgtgtgtgtattagaggtgtgtcttaatcttttggactagggactacccagtaaccaccctgagttcagttttgtatcactttgagactaaactgctgtggtaatatttgttagaccctgaaataaattactgacatgac

SEQ ID NO: 1365 - DNA, 350 bp, Homo sapiens
tcagttatcatattttgattttcaccaacaaaaattttatgaacttttctttctggttatagaaatacctaaataaggctgggtagggtggctcacacctgtaatcccagcagtctgggaggccaaggcaggcagatcatgtgaggtcaggagttcaagaccagcatggccaacctggtgaaaccccatctctactaaaaatgcaaaaattagccgggcgtggtggtgcgcacctgtagtcccagctcccctggaggctgaggcaggagaattgcttgagcacgggaggcagaggttgcagtgaaccgagatcacaccactgcactccagcttgggcgagagagagcaag

SEQ ID NO: 1366 - DNA, 219 bp, Homo sapiens
aagaacacacaactggcaaatgattgatccacaattaaaatacagattgcaagtttccactgcttcactgagtcacaaatttcaatcattcagaatccatctttatggtttcactacatctggatatcactttactatcatacacttaacgtttatcttttaattgactaattctttttccttaaaattttttaaaaggaaactatcaccccctaagag

SEQ ID NO: 1367 - DNA, 331 bp, Homo sapiens
tctttttttgcaacagcagtgttttgggtgataattttgaattgataactgttcctttttctgggttttgttggccttttgaaaaattgtctttcgttatcgttggtgggtggcttagaagcaaagtaaaattttttggaaaagagaacagaaaattgaactgcagcttgagaacatattgtttttttcctactttgtcattgaaaattgaagaattgcttttaactgttttaggtgtgtgtgtccagagtgagcaaggactatgtttttggattgtcaaagaggatgcttaatcttaaaaataaaaataaatttaaaaatcatcttgtaa

SEQ ID NO: 1368 - DNA, 410 bp, Homo sapiens
ctggccagccttggcatctcatcctccagttccctgggcctggagctggtcctcttgtgatactgggatggcttctgccagcactcagaacctttcagggcatttccaaaccaaggagaaacaaggtgctttttcttttctttttctttttctttctatcttttttttttttttttttgagacagagtctcgctcttgttgcccaggctggagtgcagtagcgcaatctcggctcactgcaccctccgccttcctgggttcaagcaattctcctgcatcagcaccccgagtagctgggattacaggtgcccaccaccatgctcagctattttttttttttttgtagttttagtagagatggggtttcaccatgttggccatactgatctcaaactcctgacctcgtgatc

SEQ ID NO: 1369 - DNA, 446 bp, Homo sapiens
ctgtctacgggggaagtgccgagtagttgtggccttcgtggagtgttttttggagctctcgcctgtcccccacccccttccttcagctgcttctgtttgttcctgctgtagtgccttcagccatgaacataccgtttaatcagtggtgtattaaaatggacctgtacagtcagcaatagctaggccaaaatcgattggctatttttaaaaggaaaaaaggaagatagaaaattgctcttttaatctaggtaaatcaaatcgtgcctgcttgctttccacctgtagctaagtgtaggcaagagcattctgattgatgacagtgtttctttgtgcttctttattcatgcttatccacttggggtaaaagcaccagggtatcttcagaacggagttttcacattcacgtcagaaagcttgtgctctttttctctcagaaaaaaaaaaaa

SEQ ID NO: 1370 - DNA, 1271 bp, Homo sapiens
tggctcccctcctgtcatcagaggccaggcacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagcttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccacctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcactgcccgttcctatgtcctgcggtgcctggacatgctgtgagcgcctaactgcgacggctccacccgggctactacctgaaacttccgagcatcccgcttgtgcctggtgccgagggccgggctggagtcagccagcgaggagcgtgacgcccacgggcaaaaaggctgggacgggcgcgcaggtccgacaagggcgcataaacacgggctgggccgcgggctccaggccaagcgtggaggcacccaatagaacaaacggccgaacgagaaa

SEQ ID NO: 1371 - DNA, 877 bp, Homo sapiens
ggatgataaccacaacttccctaataacaaggtgcttcacggttgctagggatgataaccacaacttccctggcaactgcagtgtccgacaatttagaagggaccatccttggcggcttctctgaatatactgagcttggttgctaaaggactcatagcttagcaaccatagcccttcaaggcttttcatggctgtggcgggccccattaggtaccaaaagaagaagaaccccattgtcagtgaactgtaccacccagcccacccaccttcctaccctacaggcaccctctgggccaccctcccttgctgccctagcaagtctgacagccagagggccattgcctggccaggatcccttccttagcatccggggctgggacactagcaggcgtcgggagggggcctggctgagctgcatgtctgtcccccacctcatcctccaccccccagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcactgcccgttcctatgtcctgcggtgcctggacatgctgtgagcgcctaactgcgacggctccacccgggctactacctgaaacttccgagcatcccgcttgtgcctggtgccgagggccgggctggagtcagccagcgaggagcgtgacgcccacgggcaaaaaggctgggacgggcgcgcaggtccgacaagggcgcataaacacgggctgggccgcgggctccaggccaagcgtggaggcacccaatagaacaaacggccgaacgagaaa

SEQ ID NO: 1372 - DNA, 796 bp, Homo sapiens
ctctcttgtggctgaggaagtattgcccccgtgttgctagggagatggcacccccggcaaccaggagtagactgcccttgtgttcctgacagctgcagtcagccttcccccaggggcttggactgcggctgggggaacagcctgttgatgtaaatgatgaactactactccctgctagggttgtcccctagtcgtcacaaactgccattctgttgtgggggtagtgacacccccacgggaatttgttaccactgccctaataaccgtgccctgacctccagctgctagagagaggatgtccccctagtaaagccaagcaggaattgaaggtttttctaaatctgctcggtcctcactcctaaaggatggctcccctcctgtcatcagaggccaccaaggcttcatatgggccagtgtttcccactgctggggctgtcgacatgagtgatgagggagccactgtattgctagaggtgacacttctccaataatcactgcgaccaggaaaaaagccccttcctaaaagcctttctaaacatcctaggcattgttgctaaggaatgccttttccttagcaacaaagatcatggggaccccactggcgcctggaacatctccctagcaaccgtgaagcaccttgttattagggatgataaccacaacttccctggcaactgcagtgtccgacaatttagaagggaccatccttggcggcttctctgaatatactgagcttggttgctaaaggactcatagcttagcaaccatagcccttcaaggcttttcatggctgtgg

SEQ ID NO: 1373 - DNA, 496 bp, Homo sapiens
gagatggagttttgctcttgttgccagggctgcagtgcaatggtgcaatctcggttcactgcgacctccgcctctcgggttcaagcgattctcctttctcagcctaccgagtagctgggattacaggcgcgtgccaccaggcccggctaatttttgtgtttttagtagagacggggtttcattatgttgatcaggctggtctggaactcctgacctcaggtgatccacctgccttggcctcccaaagtgctgggattacagacgtgagccaccgccccggcctaaatttaaccatctttaagtatacatttcagtgacattaagcctgttcacgttgtgcatccatcagcagaatttgtcattatcccatactgaaattctgtatacgttaaacgcttacgccctattctcttttccccagcctctggtaaccaccattctactttcaccttttggccactgtgaatgatgcttctgtggacattagtatacaaat

SEQ ID NO: 1374 - DNA, 522 bp, Homo sapiens
acttgaagctcaatcagaatttcccaaggcccagatttgcaactgatatctgggggtgagggtggtcttggggtctgagccctcaatctgtgggatctgatgctacctccagatagatagtgaaggaactgggtggaggtcctggcttgtgtctgcctcttggtggtggggagaagttcccacacatatggtcacaggagtcttctgtgttgatgattgctgttgtggtgtgagagcagaggaaaaacacagtttgagagagttttcccaaaataccatggaattctttggctattcttaggccttttctcatccagataagatactgaatcagcttatcaagggccaacttattgaattgttattgaatttgagatgaatcaataaagagaaaggagagccatgaaattagaaaaactaccctaattaagtcttcccttctaaaagtcaggaaaactagcattacttgaaaatgagtaccaaaaaaactaaggtcaaatcccatacaaagtcattatgaag

SEQ ID NO: 1375 - DNA, 632 bp, Homo sapiens
acttgaagctcaatcagaatttcccaaggcccagatttgcaactgatatctgggggtgagggtggtcttggggtctgagccctcaatctgtgggatctgatgctacctccagatagatagtgaaggaactgggtggaggtcctggcttgtgtctgcctcttggtggtggggagaagttcccacacatatggtcacaggagtcttctgtgttgatgattgctgttgtggtgtgagagcagaggaaaaacacagtttgagagagttttcccaaaataccatgtcttggagcgcttgctctggagaagccagaggtcatgtcgtgaggatactcaagttgccatttggagaggtgcacatggtgaagaaatgaggcctactgccaatgaccatgaattctttggctattcttaggccttttctcatccagataagatactgaatcagcttatcaagggccaacttattgaattgttattgaatttgagatgaatcaataaagagaaaggagagccatgaaattagaaaaactaccctaattaagtcttcccttctaaaagtcaggaaaactagcattacttgaaaatgagtaccaaaaaaactaaggtcaaatcccatacaaagtcattatgaag

SEQ ID NO: 1376 - DNA, 380 bp, Homo sapiens
tttttttcctgggttctccattctgtttcatttgtatgtgtttccataactacactaataacagtgttaaattattaaaactgtataatatgttttgacatctgatagggcaatctttcatttattcttctctttcaggaattctttggctattcttaggccttttctcatccagataagatactgaatcagcttatcaagggccaacttattgaattgttattgaatttgagatgaatcaataaagagaaaggagagccatgaaattagaaaaactaccctaattaagtcttcccttctaaaagtcaggaaaactagcattacttgaaaatgagtaccaaaaaaactaaggtcaaatcccatacaaagtcattatgaag

SEQ ID NO: 1377 - DNA, 757 bp, Homo sapiens
ggaataccacatacatgatgtttacttggttcattggataagaagcccgtgatgtcggtttgtcctattattggtgataccaattttggccacttggttaagtggcatgtgtgaggttttttcattgtaaaactgttatttcctttttgtaattaatatgagacactttgagactacgcggatatcctctccctcatcaaacttttctccaccaactttagcatctggttgccaccctccaaaatggccccagtgatcccatctcctaataagtacatgtctgtgtggtcctctcccacactgcataggaatggcttacgtaaccaataggtagttgaggatgtgatgcagtctgacttttgaggctaagttgtaaagaaagacactgtgtcttcctccttgttgtcttggagcgcttgctctggagaagccagaggtcatgtcgtgaggatactcaagttgccatttggagaggtgcacatggtgaagaaatgaggcctactgccaatgaccatgaattctttggctattcttaggccttttctcatccagataagatactgaatcagcttatcaagggccaacttattgaattgttattgaatttgagatgaatcaataaagagaaaggagagccatgaaattagaaaaactaccctaattaagtcttcccttctaaaagtcaggaaaactagcattacttgaaaatgagtaccaaaaaaactaaggtcaaatcccatacaaagtcattatgaag

SEQ ID NO: 1378 - DNA, 365 bp, Homo sapiens
ggatatcctctccctcatcaaacttttctccaccaactttagcatctggttgccaccctccaaaatggccccagtgatcccatctcctaataagtacatgtctgtgtggtcctctcccacactgcataggaatggcttacgtaaccaataggtagttgaggatgtgatgcagtctgacttttgaggctaagttgtaaagaaagacactgtgtcttcctccttgttgtcttggagcgcttgctctggagaagccagaggtcatgtcgtgaggatactcaagttgccatttggagaggtgcacatggtgaagaaatgaggcctactgccaatgaccatgtaagtgagccaccacggagatactccca

SEQ ID NO: 1379 - DNA, 451 bp, Homo sapiens
tttttttttgagatggagtctcgctctgtcgcccaggctggagtgcagtggcgcgatcttggctcactgcaagctccgcctcccgggttcacaccattctcctgcctcagcctcctgagtagctgggactataggcccccgccaccatgcctagctaatttttttgtatttttagtagagacagggtttcaccgtgttagccaggctggtctcgatctcctgacctcgtgatctgcccgccttggcctcccaaagtgctgggattacaggcatgagccaccacacctggcccatgtccacatattctaaacatcagaaaacagcaaatacattgtagttctgttcaaatttctacttctaaagttatgtgtgcaactagggacacactgagatttatggagaaaaggataaaagcaaagatttaaaattacatgctagacttagtaacata

SEQ ID NO: 1380 - DNA, 1504 bp, Homo sapiens
gctttctgctaaggatgtattgtggcttttgtttggattgcagcatgcagaattacagctgttcagaggagactcattacaactcctgctgaagctcctaatcttcttcccttctcttctaccctttccccctaccctcacttggcctgaagacgttctccccagagtttaccttgctcccctggtgctatgtgtatggtgaacctggcactatggccgcgtctgggactggccagacaactgctgctggctctccttattccaggaaggatttaaaggggaattgcactgcaggcaatgcaccagagcagcagcatcaggagcttggggagtaaggctcctctggcattattacacacatgcaaagctgaccgcaatgacagcagctgcttctttgaactgttggcagcagccaagcggcagcatgaagtgacagatcactcctgagctcaagatgaactccaccttggatggtaatcagagcagccaccctttttgcctcttggcatttggctatttggaaactgtcaatttttgccttttggaagtattgattattgtctttctaactgtattgattatttctggcaacatcattgtgatttttgtatttcactgtgcacctttgttgaaccatcacactacaagttattttatccagactatggcatatgctgacctttttgttggggtgagctgcgtggtcccttctttatcactcctccatcacccccttccagtagaggagtccttgacttgccagatatttggttttgtagtatcagttctgaagagcgtctccatggcttctctggcctgtatcagcattgatagatacattgccattactaaacctttaacctataatactctggttacaccctggagactacgcctgtgtattttcctgatttggctatactcgaccctggtcttcctgccttcctttttccactggggcaaacctggatatcatggagatgtgtttcagtggtgtgcggagtcctggcacaccgactcctacttcaccctgttcatcgtgatgatgttatatgccccagcagcccttattgtctgcttcacctatttcaacatcttccgcatctgccaacagcacacaaaggatatcagcgaaaggcaagcccgcttcagcagccagagtggggagactggggaagtgcaggcctgtcctgataagcgctatgccatggtcctgtttcgaatcactagtgtattttacatcctctggttgccatatatcatctacttcttgttggaaagctccactggccacagcaaccgcttcgcatccttcttgaccacctggcttgctattagtaacagtttctgcaactgtgtaatttatagtctctccaacagtgtattccaaagaggactaaagcgcctctcaggggctatgtgtacttcttgtgcaagtcagactacagccaacgacccttacacagttagaagcaaaggccctcttaatggatgtcatatctga

SEQ ID NO: 1381 - DNA, 499 bp, Homo sapiens
atcagatatgacacaaagggagacatcaaaatgcaacgtaaagttaaatcatagttacctttttttgaagctgttggcaaggtttgaccacttggggcatcttctgctgtgagatgacacttgaaaaacacccatcaaagttttcctggtaggaatctctctttactgcgtgtttttttgaaaagctgacagagaatatgctttggctttgacactaatgaagtcacccatcatcaattacatacagctaattgttgggagctagagctagaatccaagctttctgattctctgcatggaagaggaaatgctctagggcccttcagggcaaatcttaaaaggaagttcttggccgggcgcggtggctcatgcctgtaatcccagcactttgggaggccgaggtgggtggatcacgagatcaggagatcgagaccatcttggctaacacggtgaaaccccatctctactaaaaatacaacaaattagctgggcgcggtgg

SEQ ID NO: 1382 - DNA, 568 bp, Homo sapiens
gcacaacagcagaggaaatattggcactcagcaaattagaagtcctctcccagccctgcccaactgcctgccttcatcctggtctctctagtagtcctccttttacgttagtgaaggagacaactcaagcttgtgcctgtatccagtgggaaggactctcaggacttcatcaggacagacacatcatcctgtctaagaggtgtcatcttcctttggctctgcccaactgccacatagccaaggcacttcatactacagtgatatggtttggctgtgtccccacccaaatctcatcttgaactgtagctcccataattcccttgtgttgtgggagggacccagtgggagataattgaatcatgggggtggtttcccccatactgttctcatggtactgaataagtctcatgagatctgatggctttataagggaaaaccccttccgcctggttctttcattctttcttgtctgctgccatgtaagacgtgccttttaccttctgccatgattgtgaggcctccccagcctcgtggaactgtaagtccattaaacctcttactcttataa

SEQ ID NO: 1383 - DNA, 225 bp, Homo sapiens
attagaatttataaccaaattcagcagtggatgcaaaatcagtgtaaagattaattgcaagtctataatcagcaatcaatatttagaaaatgaaataaaaaatagcattcaaaatagcataagaagtcatgtacctaggtataaatctttaaaaaatgtgcagaacccttgtgaaaattataaaatttaataagaaaaaataaaggcaacttaaataattgaata

SEQ ID NO: 1384 - DNA, 351 bp, Homo sapiens
tgctgggattacaggtgtgagccacctcgcctggccaccctttattctttgtagcattatcactctctgagctctttgatgtttttttgtctcctccactaaaccataagcttcctgagagctgtgctttgtcttgttcatcacttgttcttggcttagaggatggtgctccacaaattctgggatgataaagtgtggctgtgtgaggggccaaggcactgtgctgggtgctggcagtgacaaatgaggcagccctggcccctgtcctcgtggagctcacattctggagggatttgttgaatgaacagaagggggacagagagttgtgctaatgaagacctctaaatattt

SEQ ID NO: 1385 - DNA, 436 bp, Homo sapiens
gagcaggctgaagctgtgccctctggctggcctgacgggggtctgctgggcatggacccctgcgtcaggtttgtggctggcgtgcacgttcccaattaagccgagtaaatatttacagccattacggccattgatcgccttcgatcctgggtgctgctgtgagatgcccctgcttactcatgctttcttaaaaacagctcttccctgcgcgtctttaataattcaactcctaattgtctccaaacgcaaacctgaaaatgccaactcagggccttcgcccccgctctggtccccctctcgtcccctctgccggagacctggtgcccaggagatgctataaatattgatttggcttcacctccacccccagcccttggcaggggaggtctgggctgaggcctgtccagggacccattcagaatcagcctcccctgtc

SEQ ID NO: 1386 - DNA, 410 bp, Homo sapiens
tgacaattttgtagcactggttatgtgttgggtacctttaatctctatagtcatcctatacagtaggttttattatcttcattttagggacagggtaacaaaagtacggagagggtatgtgatttacttaattctacagtcatggcagaaagcttaggacaaatgtgagctaaatctcatgtgtgaattcaaatcccatgttcttctgtgtcatgtcatctcttgagaagatgagctgattaatcatttccttttcaccaaaacttgcctatagtcaatgaaaaggatgccttctttatatgtgaaatgtacaaggtaagatattcagaatagttgaagtcttccttgactgaagtttccacctggctggaaaaatggatcaagattactccagaaagacaatgcagaga

SEQ ID NO: 1387 - DNA, 478 bp, Homo sapiens
tcatacaaatggaacaacagaaatgcagtgatcctggagagtcttaggctgagaaacagttggtctcatcaaatgagtttctctaagagtagatcatttgggggcccatatgttagacagctagttgagtatttctaccccttaaagatatggcagcttacaacccttgaaggacaattaattctgttaatatgttggtactgaccagtgaattcaaactataatttcctcatatgacatatttgtaacagccagcttgtttctcccttctatttccatagcccacaaagctagaacactctaatttgtctaactggtgagtggaactcaaagtttttagtcaggaagaacttgaaacctgaccaagtctccaagcagaatgcataatgcacattggctacagagttatatgggagattgtccctaaaaaaagtgtgaatcataactgtataaattaaaataaatctgtgtgtatact

SEQ ID NO: 1388 - DNA, 1486 bp, Homo sapiens
tgtgttctctctaaaggatcattgttggcttaaatatttccagagcattgtagagatgtgtaaaggtagaaattttggtagtagttaatgaacacatgccaggccaaaattattagaaggaaaagtttaagtttattttaaaattagtgttttgaggatagtgagacattgcttacagctttcgaattatttttgtatcttttgcccacttttctatttagaagtttcttttcttactgacttgtaagaatcctttgttttctgtttgaagagagtagaccctcatatattggcaaatatttactcatattgctgtttggcttttgactttgatgttttctggtatttaagaaataaacatacagaattttaaaaattatatctaaatatattaatatttttcttatcgctactaggcttcatgcttacgattgccatactccaagattaatattccattgcattttcttattttgtgatgtaaattttagtgttttggtatttgtatttaaatatatctgggttttatttaaatagtatttactgtgttaatgcattttatgctatgaaataaacggtacatgttagtttaataggaatttaaaaatatgcaaaatatcccaaagtaaatctggttcgatttttgggaataataataagatatgtataagagaatcccagcatagagaaactaccagaacctattcataaaggagaatgaaaagaagatgatctttgtaagtgagcacaaggtttgagaggaagctagaatagagaaggcttgaatacttagcaaagaaatttacatttattttgatgaacactagtaataattaacagcctggatcataatttacaaaggacttttcatatgtagttggccctttgtatctctaagtttgcatctgtggatttagccaaccttggataaaaaaattccagaaagaaaaagtaaaaaatacgaggacaatacaagagtaaaaaataatacaaataaatacaatataactactatttacataccatttaccttgtattaggtattataagtaattgagagatgatgtaaagtatactggagggtagtgttagttatatgcgtatactacaccagtttatatgagggatttgagcatccttggattttggtatccatgggggtcctggaaccaagcctccttgatataccaagggatgactggattactgtgtgtttgtgtgcttgtttttaagcttcaaaagattatgtgatctaggagttgttagattttattattggtcttaaaagataagcttagatgtgttactttttttggagttttagtttacagtgattcatgaatcgggcagcttcagaccacaggagacatgaagcaggtagaagttcaagaaagcaagacaagcaaaatatttgattggttagaagttaattgtggtttctgattagtaaagttcctagttagaggttagttggaggtttctgatt

SEQ ID NO: 1389 - DNA, 2707 bp, Homo sapiens
cttggctgtcctttacctcatggtgtggggtgtgcagatagcaggttgtggcttggtgagtgctcttcacttcaggtcaaggtgaggcacagttaacatgctaactactttcctcagttctctctgagttgtgtaaagctcccgatgccagacttcctcttaattttgcacattattaaagtccaaagagttaagatttggtgatgtggggcaaagggccagctgtcacagaaatcaatgaaatgatacacagaaatgggtatcatgaaaaggccactggacttgggaaaactgggtgcctgtccttgccctgccatgtacttacctgtgtgactggaggtgagatgttttacctatgggcctcagtttctcattacaaaatgacagagaagactagatacctaagttcctaagtttgtgacatttgtgaatttttcttggccctctgtgagtagagtgctaaatttagaggcttcctgtggttgaactgatgtccaattctcagggaacccagacttctcagttcagaacccagttccagatttttgtgggaatagggaaaggtattaaataactccattgaattctttcctgcataatgccctgctgtggctgagactcaatgaggtcatcacctccaacacacagaacccctcatcatctccttacagccagactggagcttccaaggacatcaggttggcaaggattgtgagtaccctaaacatctaaagagtccctctaataagggacatatttgttcttcaacagtttcctaacttgagaccacaaatgcgtaatctctctaatatcctaaagcttggacaaactgggcagcccctgagcagaccgcacagagcttaaatgtcagtgctttccttccagaaagaaaaagaatggtcctacacctcccaatccatgggctgatacatatgccaagggagccggatgaagaagtgggtgattttaaatagctaagactgcccatgggcaaacgttctttggcttttctcctctgcaataagtataccttcctctctcctggtccttttctcctttcccaggcccctctatcaataataattctggctctcagatgactacagttgattaggtggaactgataggataaaggtgacacccttcccaaggctatctataatgcaaaaagatatccaagaaaaagagaggtagggaacaccttgggaaaccatttctggaagacagccagtccctgctgtagacaagcctcattttccttcccccaaatgttaaagagtaaattcctcctgtagccttagctctcttttctatctttggcttgctttttatgaactatctttagagtgccaaattagaacagggtaggcagaggcaggaatatgcccaaatttgggaagacctgattgggaatagtcgaaagccttgatatgtgcaaagaaagaaccatttgatcaacccagttcttaatacaggatactaacttaaaatttagactcaagttatacgataattcaaacatttattgtatttatactattctatatgtacttttccaggaaccaggaatacaaaactgacatttctctgtacagaggctcagactagtagagaacagttaggtacgccgttaattataaactaatatgtatcatcaattatgggtttttatgggggtttggcaggtggaagggaccagggagagatgatgagtgatgatggttatgtagtctttaggaggatgcaattataacattgctcttcctttcacgcaccacatgatttagcaagtacttcatattggctccaccattaacatggtcaatggcttctggatactcacagttcaggcacagtttctcctgaagattttttacctctcccatctttaagaaattgtctggatgtccatgaaagatgctgacacttgtattaattcattaaaaaacaccaccccctccctgaaataaactaaaaagtaatgaattcatagaaaaaaatttcaccaagattgaaactagagaatatacctagacttgcactttgagctttgagaaatgtgtacctattcaccattccaacgtgaagaagctctgcagtaggaaaaataattaacacacttatagtctactgcccatgtaaggatcagctccggctaagaggccaaagatgggtgacatcgttatgctctgcctttattttttctttcttacccacttagcttcctaattggaggaaggaggcgtggtaaaggtatatgaagactatggtttaattagaccagaaaacactgtcataatctctggggtcatcagaatgtccagttttgtctttgggccaagataagggcagtgggatttatgatgtgttgtttatagtctgaaactactctggtgatcaccagggtcagtttctttaatgatggtttccaactggcctaatacattaagtaagactggctgataacatgaccagacagacataaagaccctgttgggaatgacattgaactctcaaagtcaagatttcttacacaaatctatcagctggagaaaatgaaggcagtgtggtatatgtgtgcaaataaggacattatgaagcttaaatatggaatgtctcttggacccccgatgtcatctgtattctctttttcttcttgtactatatcctttgcctgtaaataaaaggtttatttgaaaaaaaaaag

SEQ ID NO: 1390 - DNA, 2587 bp, Homo sapiens
cttggctgtcctttacctcatggtgtggggtgtgcagatagcaggttgtggcttggtgagtgctcttcacttcaggtcaaggtgaggcacagttaacatgctaactactttcctcagttctctctgagttgtgtaaagctcccgatgccagacttcctcttaattttgcacattattaaagtccaaagagttaagatttggtgatgtggggcaaagggccagctgtcacagaaatcaatgaaatgatacacagaaatgggtatcatgaaaaggccactggacttgggaaaactgggtgcctgtccttgccctgccatgtacttacctgtgtgactggaggtgagatgttttacctatgggcctcagtttctcattacaaaatgacagagaagactagatacctaagttcctaagtttgtgacatttgtgaatttttcttggccctctgtgagtagagtgctaaatttagaggcttcctgtggttgaactgatgtccaattctcagggaacccagacttctcagttcagaacccagttccagatttttgtgggaatagggaaaggtattaaataactccattgaattctttcctgcataatgccctgctgtggctgagactcaatgaggtcatcacctccaacacacagaacccctcatcatctccttacagccagactggagcttccaaggacatcaggttggcaaggattgtgagtaccctaaacatctaaagagtccctctaataagggacatatttgttcttcaacagtttcctaacttgagaccacaaatgcgtaatctctctaatatcctaaagcttggacaaactgggcagcccctgagcagaccgcacagagcttaaatgtcagtgctttccttccagaaagaaaaagaatggtcctacacctcccaatccatgggctgatacatatgccaagggagccggatgaagaagtgggtgattttaaatagctaagactgcccatgggcaaacgttctttggcttttctcctctgcaataagtataccttcctctctcctggtccttttctcctttcccaggcccctctatcaataataattctggctctcagatgactacagttgattaggtggaactgataggataaaggtgacacccttcccaaggctatctataatgcaaaaagatatccaagaaaaagagaggtagggaacaccttgggaaaccatttctggaagacagccagtccctgctgtagacaagcctcattttccttcccccaaatgttaaagagtaaattcctcctgtagccttagctctcttttctatctttggcttgctttttatgaactatctttagagtgccaaattagaacagggtaggcagaggcaggaatatgcccaaatttgggaagacctgattgggaatagtcgaaagccttgatatgtgcaaagaaagaaccatttgatcaacccagttcttaatacaggatactaacttaaaatttagactcaagttatacgataattcaaacatttattgtatttatactattctatatgtacttttccaggaaccaggaatacaaaactgacatttctctgtacagaggctcagactagtagagaacagttaggtacgccgttaattataaactaatatgtatcatcaattatgggtttttatgggggtttggcaggtggaagggaccagggagagatgatgagtgatgatggttatgtagtctttaggaggatgcaattataacattgctcttcctttcacgcaccacatgatttagcaagtacttcatattggctccaccattaacatggtcaatggcttctggatactcacagttcaggcacagtttctcctgaagattttttacctctcccatctttaagaaattgtctggatgtccatgaaagatgctgacacttgtattaattcattaaaaaacaccaccccctccctgaaataaactaaaaagtaatgaattcatagaaaaaaatttcaccaagattgaaactagagaatatacctagacttgcactttgagctttgagaaatgtgtacctattcaccattccaacgtgaagaagctctgcagtaggaaaaataattaacacacttatagtctactgcccatgtaaggatcagctccggctaagaggccaaagatgggtgacatcgttatgctctgcctttattttttctttcttacccacttagcttcctaattggaggaaggaggcgtggtaaaggtatatgaagactatggtttaattagaccagggtcagtttctttaatgatggtttccaactggcctaatacattaagtaagactggctgataacatgaccagacagacataaagaccctgttgggaatgacattgaactctcaaagtcaagatttcttacacaaatctatcagctggagaaaatgaaggcagtgtggtatatgtgtgcaaataaggacattatgaagcttaaatatggaatgtctcttggacccccgatgtcatctgtattctctttttcttcttgtactatatcctttgcctgtaaataaaaggtttatttgaaaaaaaaaag

SEQ ID NO: 1391 - DNA, 717 bp, Homo sapiens
tgagacagtctcgctctgtcacccaggctggagtgcaatggcgcgatctcggctcaccgcaacctctgcctcctgggttcaaacgattctcctgcctcagcctccctactagctgggattacaggcatgcgccactatgcccagctaatttcatatttttagtagagacggggtttctccatgttggtcaggctggtctcaaacacccgacctgaggtgatctacccgcctcagcctcccaaagtgctgggattacaggcatgagccaccgcccccagccaagggccactttttaaagggcaatattttacaccatggaaggagggaagtggagaacagaaaaaaaaggaaggcaaagctaatggccgtcaagggtgtcttcaaggctatgacacagtcgtctgtgagattcagcggttggagggaagtgaggaagaacactgagatcttgatgtgatttcctgagtctgttgactgaggcaggaggtgatcccaatgcctaggggcggagggagggtggagaggggtcacgaagggagttcaggcggttctgaatggctgggcctgcttgtaggtatttgcgattgtctgtacatgtgagtgtgtgtgagcatgtatgacagtgtgagtgagtgtgacagcttgtatgtgtttgagtgtgtataatggggtataaggttgtgttagtgtgtgcctgtgtgtgatgatgtctattat

SEQ ID NO: 1392 - DNA, 450 bp, Homo sapiens
gatgataaacactttacataaagaaatgtatgtagtgtaaattatattaaaatatactcttcatgcttcttaaatgtctttgaaaacttgactagtttaccaacagaacactaataaattaaatgcacatgtctaaaaattaaaaactttgtgtaaaataatacttttcagttgggtgcagtggctcatgcttgtaatcccagcactttgggaggccgaggtgagtggatcacgaggtcaggagtttgagaccagcctggccaacacagtgaaaccctgtctctactaaaaatacaaaaattagttgggcatggtggcacgtgcctgtagtcccagctactcgggaggctgaggcaggagaattgcttgaacctgggaggcagaggtggcagtgagctgaaatcatgccactgcactccagcctgggtgacagagctagactctgtctca

SEQ ID NO: 1393 - DNA, 400 bp, Homo sapiens
tatttcaaaatccagagttgtttactagtgctatatataagttgaataacacatgagtttgtaagtgagctaacaatatactaaagacatttctaaggatagcaataaacaattgttgcagccaggtgcggtggctcacatctgtaatcccagaactttgggaggctgagacgggcagatcacttgaggtcaggagttcgagaccagcctggccaacatagtgaaaccctgtctctactaaaaatagaaaaaaaaaaaattagccaggcacagtggtgcacgcctgaagtcccagctactcgggaggctaaggcaggagaattgcttccttgaacccaggaggcagaggttgcagtgagctgagattatgccactgcactccagcctgggtgacatagca

SEQ ID NO: 1394 - DNA, 1390 bp, Homo sapiens
tttttttaagagacagtcttgctatgttgcccaggctggacttgaactcctagtctcagccaaccccttctgcctcagcctcctgagtagctgggatcataggcatgtgccactgctcctagctcttccatctcagtcttatgatgtagttactattttcattttataaataagaaaatagaagctcaaataaaatgggtagtttccttgaggtcatcctgttagtaagtggtggaatgaagttacaaacctaggttttattggtcagcacacacagtgccgggcactggcagtacagcagtgaacaaaaggtctgttggtttgtctgaagctctcaaccttgattctgcatagactcggtggattgcccaaggccactcaaccagttaatatcagagccagctctgctgtttgaccagtatattattttcaccatgctgtatctgcttctcagtcaccaaaagcaccagctaaaattgtatatagactgattaggggacttccaacctaagattgtcctggaaacttaattcttatcttggctcatctcttcaaaacagatgcctctttcgttggtgacctcagatacactgttcagaagtactcaaagtattccttttttctcacatttgagagtcactctagcattttaatgagttaagcaagccagccctgcatttccaaacccttcccagaagtctaaccttactttgatctgatgacatgggctttttaaaagattactattttttttggaggtggggtctcactatgttgcccaggctggaatataatgggctattcacagggcacagttagggtgcactactgccgtgaactccaggactcaagccatcttcctgccacagcctcctgagtaacctaggactataggtgcatgccaccatgcccagctgacaatggctttatatacataatatttccctcagcaacaatttatgtcttatttggcacctgtaaaaccctcttcactgattatgcctgtttaaaggtttggtatttactccaagtcacctgcctttagccatggagtattcaagtttctttcagaatgagaatttggagggtgctcatagaaatataaaacaaggctgggcatggcggcttacaccttgtaatcccagcactttaggaggctgaggcaggtggatcacgaggtcgggagttcgagaccagcctggccaacacagtgaaacctcatctctactaaaaatacaaaaattagccaggcatggtggtgcatgcctgtgattccagctgctcggaaggctgaggcaggagaatcgcttgaacgcgggaggtggagtttgcagtgagccaggatcacaccactgcactccagcctgggcgacagagagactctgtctca

SEQ ID NO: 1395 - DNA, 1163 bp, Homo sapiens
gtaaaagtatacaatttcagattactgaattttggaaaaattttaatacttacatttacatatcagagtatactatctgagaatttactacaataggaaataatgaagtcattttataaaactcagactgaggaaaatgtaaaaaaaaaatacatattattattattatcatgctcccttccatttttaaatccttgaaatgtatttcatgttgagattatagaggtttttgttttgttttgtcttgtttctttctcaatactattttttcctcctctcatagctttccagaggaaggaaattgagtaagataattgaataaatgaatgaatacatgtacagcattttctgatactaagtaaatacaaagtaaattttattgttgtcattttttattttactgttgagggtatggaagacatcatctgttgccagtacaagagctgtttttttttccttcatacatagtcacataaccctaattttgttccagtggcaatgtgctcagggaagatgagcttattccataacctgaggtaataagtcattgacctaaaccagtttttatgtctttttgccaggaattggtttggaagtggacatgtgacctagttttagccagtgagatgaaagtcccttgtggagcttctgaaaaagtttttctctctgataagaggagagagggcaaaaagaaagccttccccttttcctgctccttgtcattttagaaagtgatgtgtgaagctgctatagccatttttaaactatgattgtagatatcagcacatgagaagattagaagaagagaaacatgaggaaacctttgcaaagtccttaagtgatattattgagctactgaagcaaatctggaactatataccttccaacttaatattaggtgaagtaagaaaatagtcattcacaaccgttgagtgattactaaatgtcaggcaccatttaaggctttgagatacattagtgaataaaatagacagaaatgactattctcacttatttgttgggtgttttattacttgtagcctaagtgtactgataaagagatttaattacatctgtcaggggttcacaaactgtagcttgtgggtcaaatctggcctgccacatctttttataaataaaatttattggatcacatgccactt

SEQ ID NO: 1396 - DNA, 4010 bp, Homo sapiens
gcagggctcacagcagcgttccgcgtcatggggatttggcagcgtctgctgctttttggtggggtgtcgctccgggctggtggcggggccactgccccgcttgggggaagccgagcgatggtttgtgggcgccagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcagtgaatcttgcacttgcactagcagcgaacgattcgtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtcaactggactacttagttgtagacatgccaccaggaactggagatgtgcagttatcagtctcacagaatattcctataacaggtgctgtgattgtctccacgccccaggacatcgcattgatggatgcacacaagggtgctgagatgtttcgcagagtccacgtgcccgtccttggccttgtccaaaacatgagtgttttccagtgtccaaaatgtaaacacaaaactcatatttttggtgctgatggtgcaaggaaactagcacagacccttggtcttgaagttctaggagacattcccttacaccttaatataagggaagcttcagatacaggccagccaattgtgttttcacagcctgaaagtgatgaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcatgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatacgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaagggaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaagaggagagagggggggcgcccctcgaaaatataatctctctctcgccgggggcgacccccatctcacccaaccccaccccttttttttctcaaaaaaaggggccgcccccactagaggggcggtctcataaaataacaacaaagaaggaagggggggccccttgcctaaacaaaagcacgtcccggacgggagcacacaaaccaacccaccacgtgcctgaacttcttctagggagggaaaacaacccccctcctgtgcggggggagcacacaccaattgcacgggaaaccacccaccccccaacaacgactaaaccgcctcctcgaggaacagaccacaacccgcccagcctgctcacatggcggcgccaacacccacccgccgaactccatcctcgccgcagcaacaaaacactctgtgcccagagtacgactatcagctccggcacaaccaacctcacagcggccgcgccccgcaccacaaacacaacccggaccgctcgagagcagcacgactcgcgcacccgacaagccaagatgccagcgcacatacccgactggccgaggacgcagccagactagccacatcgaaccagacagataccacgtacagagagcaagcaacagatcgaggcaccaccgacagcccgacagcaagaacctacaacacagcaccaccgacgcacacagcagcgcaccacaacacacccaaacacacgcagacacacccgccacacactaaccctgacaccaagccatacgggcgcacagacacacaacgga

SEQ ID NO: 1397 - DNA, 3019 bp, Homo sapiens
gcagggctcacagcagcgttccgcgtcatggggatttggcagcgtctgctgctttttggtggggtgtcgctccgggctggtggcggggccactgccccgcttgggggaagccgagcgatggtttgtgggcgccagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcagtgaatcttgcacttgcactagcagcgaacgattcgtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtcaactggactacttagttgtagacatgccaccaggaactggagatgtgcagttatcagtctcacagaatattcctataacaggtgctgtgattgtctccacgccccaggacatcgcattgatggatgcacacaagggtgctgagatgtttcgcagagtccacgtgcccgtccttggccttgtccaaaacatgagtgttttccagtgtccaaaatgtaaacacaaaactcatatttttggtgctgatggtgcaaggaaactagcacagacccttggtcttgaagttctaggagacattcccttacaccttaatataagggaagcttcagatacaggccagccaattgtgttttcacagcctgaaagtgatgaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcatgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatacgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagtta

SEQ ID NO: 1398 - DNA, 3947 bp, Homo sapiens
gcagggctcacagcagcgttccgcgtcatggggatttggcagcgtctgctgctttttggtggggtgtcgctccgggctggtggcggggccactgccccgcttgggggaagccgagcgatggtttgtgggcgccagttgtctggcgccgggagtgagaccctaaaacaaagaagaacacaaatcatgtcccgaggacttccaaagcagaaaccgatagaaggtgttaaacaagttatagttgtggcttctggaaagggtggagtcggaaaatctactacagcagtgaatcttgcacttgcactagcagcgaacgattcgtccaaggccattggtttgctagatgtggatgtgtatggaccttcagttccaaagatgatgaatctgaaaggaaatccggaattatcacagagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtcaactggactacttagttgtagacatgccaccaggaactggagatgtgcagttatcagtctcacagaatattcctataacaggtgctgtgattgtctccacgccccaggacatcgcattgatggatgcacacaagggtgctgagatgtttcgcagagtccacgtgcccgtccttggccttgtccaaaacatgagtgttttccagtgtccaaaatgtaaacacaaaagagacattcccttacaccttaatataagggaagcttcagatacaggccagccaattgtgttttcacagcctgaaagtgatgaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcatgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatacgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaagggaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaagaggagagagggggggcgcccctcgaaaatataatctctctctcgccgggggcgacccccatctcacccaaccccaccccttttttttctcaaaaaaaggggccgcccccactagaggggcggtctcataaaataacaacaaagaaggaagggggggccccttgcctaaacaaaagcacgtcccggacgggagcacacaaaccaacccaccacgtgcctgaacttcttctagggagggaaaacaacccccctcctgtgcggggggagcacacaccaattgcacgggaaaccacccaccccccaacaacgactaaaccgcctcctcgaggaacagaccacaacccgcccagcctgctcacatggcggcgccaacacccacccgccgaactccatcctcgccgcagcaacaaaacactctgtgcccagagtacgactatcagctccggcacaaccaacctcacagcggccgcgccccgcaccacaaacacaacccggaccgctcgagagcagcacgactcgcgcacccgacaagccaagatgccagcgcacatacccgactggccgaggacgcagccagactagccacatcgaaccagacagataccacgtacagagagcaagcaacagatcgaggcaccaccgacagcccgacagcaagaacctacaacacagcaccaccgacgcacacagcagcgcaccacaacacacccaaacacacgcagacacacccgccacacactaaccctgacaccaagccatacgggcgcacagacacacaacgga

SEQ ID NO: 1399 - DNA, 3651 bp, Homo sapiens
gttgcaggtcttgttccagaccaccacaataaagcaagtgtctcaataaagcaacctaatgaggcctctcttgaattatggtattgcttgtatgtctatgggctttctggttgaagaaagtgaaccagtagtttggagaggccttatggtaatgtcggccattgagaaattgttgaggcaggtagattggggtcaactggactacttagttgtagacatgccaccaggaactggagatgtgcagttatcagtctcacagaatattcctataacaggtgctgtgattgtctccacgccccaggacatcgcattgatggatgcacacaagggtgctgagatgtttcgcagagtccacgtgcccgtccttggccttgtccaaaacatgagtgttttccagtgtccaaaatgtaaacacaaaactcatatttttggtgctgatggtgcaaggaaactagcacagacccttggtcttgaagttctaggagacattcccttacaccttaatataagggaagcttcagatacaggccagccaattgtgttttcacagcctgaaagtgatgaggccaaagcttacttgaggattgctgtggaagtggtaagaagattgccatcaccttcagaatgattccccaagtgtcctggaaatttgcctggtactgacattaagaggacctttggaaatcagcaatgtggtgatggaacctacagaaataatagaaatcataactgttttatttctaaggaaagaatgtcttcatatttgacttgctaagctaaggttcacaaaactttgatgtatcaatgttaactgctatatttaggaattttttgaaagctggtgtgtaccacctgcaaagaactgcattttattttattgaattacccctttagaaatcatgagtttatgatgttacaagtccattttgggagagaactgtacactttttgcaggaccacagaattagtaatttaaatgatatactaaatttgtgtatgggcataagtattacgccttcccaccaggcaatttggactgtctttgaatcctgtctttggtactgtcttggacatgttcttaatatgaacctctgcttcttcatctggatcacactataccccagacttaatgaatttcagtctccaggagtggagcctgaacatatgtatttttagtaagaccatgatgatgttgatgatgattctggtaatcatggcagtaagaataatagctaacatttaacaagttaattataattgttcttccatttgtgtgagtgggtactattatctccattttacagataagtaatttgagatataatttgaaggcactcaaccttgagtgtcttgctgagggttactgtatctagcaggtgatggagcttggatttgaacttgagtaattcgatattagattcatctttttgtacaccaatgtgcttttgttaattaaaaaaagtcggtggtggctaggcgtggtggctcacgcctgtaatcccagcactttgggaggttgaggtgggtggatcatgaggtcaggagttcaagaccagcctgaccaacatggtgaaaccccgtctctactaaaaatacaaaaattagctgggtgtggtggcatacgcctgtaatcccagctactcgggaggctgaggcaggagaatcatttcaacccgggaggctgaggttgcagtgagtggagattgtaccactgcactccagcctggtcaatggagtgcgactccatctcaaaaaaaaaaaaaaaaaaaaaaaaagtcgggggagatgcaatatttagcatttcctcaaactttttttggccatgaaatccaccacccccctcctttttcagagcatttcatgaagttcacatttcaaataatacattttgaaaaacatttatcttgtctaattgaagctcaaagagatagagtcaatgacttttcaaagtcaggtagcagatagttttaaagctgcaagtactgataagtgtgagccattagttaattcgcatttataaagaagtggtctgtcacttttggcaaatgtcttgacatctgttgctctacagttgtcaactagaaaattaggcatagagtttcacattattataagcatgttttcacacaaaaacatgtacattgatgtttattgcaattttatgtgtaataaccaaaaacaacccagattttcttcattgggtaaatgattaaacaaaccatagtacattcataccgtgagtgctactcagcaataaaaaagaacaaactatgggtacaggcagcaacttataattccagagaattatgctgaatgaaaaaggccaatttaaaaaggttttgtaccaaaagattccatttatataacgttcttgaagtgacataattatagaaatggagaacagattagtggtggctgtgttaaggagggggtgaggatgggagagaattgggcgtggctgtgagaaacatgagggatccttgtgatgatggaaatgttctatatcacagctatcgatgtcagtatcccagttgtgatattgtgctatagttttgcaagatgttaccactgggggaaattgggtgaagggcacatggaatctctgtattatttcaactgcatgtaaatctacaattatctcaaaataaaaataaaagttaaaaaaacacaaactgctatatctgaactgaaatttactggaccaaattatactaattaatatcatgaataaaattatttgtggacacactgtaatcatatcactctgagaagggaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaagaggagagagggggggcgcccctcgaaaatataatctctctctcgccgggggcgacccccatctcacccaaccccaccccttttttttctcaaaaaaaggggccgcccccactagaggggcggtctcataaaataacaacaaagaaggaagggggggccccttgcctaaacaaaagcacgtcccggacgggagcacacaaaccaacccaccacgtgcctgaacttcttctagggagggaaaacaacccccctcctgtgcggggggagcacacaccaattgcacgggaaaccacccaccccccaacaacgactaaaccgcctcctcgaggaacagaccacaacccgcccagcctgctcacatggcggcgccaacacccacccgccgaactccatcctcgccgcagcaacaaaacactctgtgcccagagtacgactatcagctccggcacaaccaacctcacagcggccgcgccccgcaccacaaacacaacccggaccgctcgagagcagcacgactcgcgcacccgacaagccaagatgccagcgcacatacccgactggccgaggacgcagccagactagccacatcgaaccagacagataccacgtacagagagcaagcaacagatcgaggcaccaccgacagcccgacagcaagaacctacaacacagcaccaccgacgcacacagcagcgcaccacaacacacccaaacacacgcagacacacccgccacacactaaccctgacaccaagccatacgggcgcacagacacacaacgga

SEQ ID NO: 1400 - DNA, 332 bp, Homo sapiens
tgacttcccacaacaattgtgtggttagtatctgtctctcctattgactttgtatttcatgggggaagatattatgtctgtttttctttgctactatagcactaacaccaaacttcatacttggtacatacaggtatatctcagagatgttgcaggtcttgttccagaccaccacaataaagcaagtgtctcaataaagtaagcaacatgaattttttggtttcccattgcatataaaagttatgtttacactatactgtagtccatgaagtgtgaaatagcattatgtctaaaaatatgtatgtaccttaattaaaaatattttattactt

SEQ ID NO: 1401 - DNA, 1350 bp, Homo sapiens
  misc_feature (610)..(610): n is a, c, g, or t
  misc_feature (1004)..(1004): n is a, c, g, or t
  misc_feature (1126)..(1126): n is a, c, g, or t
atccacattcaagtgttacatcttggctgtgctaataggagctggagcctgtcccatatttttccctccccgtttcctttggggttaaaataaaatgattgaagttggttgtacactgccattgaattcaagaactttcataagaagtgtataacatcagctgtgaatgctgaaaagcttttcaagccacagtcacaatatgcctgccctcttagcagatgctggtagcggtagtctagcacaactggtactgtccctcacagagcttaggcttctggggagtattgtaccatgaacaccactgtcccagaaagtgcccgggccactaagaatcacaaaccctactgtcctcgccagtgctgtgcgtctttctttaggaggccctgagacagtttatttaacacagctgctactgtcttctgatatttgcatttgttcagcgagttgttgaaccacccagttattactaccccagtagttgctaccaaactttcatagcaacaaagggtattgttttggttagtgtaatataccagttcttctgcatgaatgtcattgaatatatttacgtatatataaaatatatgccatatggtaaattagctagggntgagaagtttgctcccttgaaatatagtttcattggcaagttataagcagcaagcaggagcatttaaaagtttatttaacaaatacttatattcactatgtgtcagggtttgttctaagtacttaaaactgttactcatttactcctaaaattcactttaaggatcctacttgaaacacaggggggttaagtcacgtacttaaggccacacaggtggtaaatagttgaattagattttgaaagcaggcagcttgactgcagagtctaatcactgcactgttgcttgtggaatctagcatgtttctcacagtttgggccctatttgtgtctttgtgtatgcaattttgccaaagaaaaaaattgcacctgttcaaacatatgatcaactccttgntttaccatgtggaggattacaactagattatatatttcaatattgctattgaaagacattgatagactgggtactgtggctcatgcctgtagtcccagcactttgggaggccaaggcgggtngatagcttgagtccaggagtttgagaccagcccaggcaacatgatgcaacccctcctctacaaaaaacacaaaaattagccaggtgtagtggtgcacacctgaagtcccagctatttgggaggcagatgtgggaggtttgctttatcctgggaggctgaggctgcagtgagccaagattgcaccacagcactccagcctgggcgacagagtgagatcctttctc

SEQ ID NO: 1402 - DNA, 419 bp, Homo sapiens
gtcctcaagatagtgagagctgagccaagacttgaaggaggtacgagaattaactacttggttatctgagcaagagtattccaggcagaaggaaaagccatggcaaaggctctaaagcaggagcacagagaaacagcggagtggccagtggaagcagagagaacagagggacaagtagtagaagataaagtcaagagagataatagaggttaccttatgtagggccctgtaaactattgtaaagacattgtacttcattcaaggagaaatgggagcctttggaatgttttgagcacagcaataacctcagctgacctatattctgaaagagtaattgtggctgctgtgttcagacttggttgcagagaaggagaattggaaaccaacaagtagagaattattgaagtaatctaggattt

SEQ ID NO: 1403 - DNA, 452 bp, Homo sapiens
ggaaggtctgtgatgtacttttcctgatattccccctccatctgtctgtctgttctcagtctacctggtcccctccagggaggctgggttaatccctcctattcccctgcctcctccagctgctgaagcattgcagtcctctgccatcctttgctgtgccaaggtgtcaccatgccagcttctgcctgttgaaagggatgctggcggaagtcatggtggctgagtcctggcacagccactgtcgagttgtctgagtggcagcagagggaaaaggcggagtatggagcagagccacctgcccactgctgcctttagagttggaaatcgcaatcctccaaggaccaaactttacacatgaaagtgcatttccaccagctgcaactttctctccatcattacctccaccaccacctccacctccaccatgacctccacctccaccatgactcccg

SEQ ID NO: 1404 - DNA, 408 bp, Homo sapiens
gatagtcaagggaggtctcccttagaagaagcctgccatggtaaattcattcaaagaatgaaacatcgtgacttgttccatgtaaaataatttgtcctctttatttctgttcttagaaatccatggaccaaatattcccaacatttctcagttacagaagtttttttgttttgttttgttttgtttttaaattgaaatccaaaaatacccttctgggaatggctgaaccccctgaaaatgtacgctaaatttattatatagatgtggttgtgtactctttctggtagaggatttccagttttcatcagatttccaaagaaatccatatcccagaataccactactatgtcaatttaatctaatttaatcccaaatttattaaatatccttataacaagcactgaatgg

SEQ ID NO: 1405 - DNA, 285 bp, Homo sapiens
tctgcctaatggacatgtggaggagggggtggaggcggactgaagagctacttatttaagaagagtggagagaaaaaaaaaaaactccacatttaggctggtgataagtatgcacagaggttttttttttgggggtggtttgtttgtttggatggaccagaaacttcccatttttttctcctcttttttagttttcccagctgcaagttataaggttcatgccagcttttgtggcatactgggagtgatgacaaattgattgctttgtactgatagagagagaga

SEQ ID NO: 1406 - DNA, 461 bp, Homo sapiens
tggtaggggtgctggtgaaatggaatggtgatttgggattttggaatcaggaaaaagatctaagttcaaaaccctgctagtccctttctggccgagttacttggacaaggtaatgtctctgtcctactggtaaagtgtatgttgcaggggaattacattctttgttggtaaaatatatgcctcaggggaattaaacagataatttatgtaaagtgcctttcacagagagtctggcacatagtaggtggtcggtcactattaattcttccagctcttgccagaaataactaaaatcagggcactaggacttccaagccgtgctgctactaataaaagaaataatatgatttattttttcacaactgtttggggaaaggcctgtgcttcataaatatgcgttggaaagtacttagcaaatgagtagaaataataaaaatatgtccaagtaaacagctcctata

SEQ ID NO: 1407 - DNA, 447 bp, Homo sapiens
atttatctgcttttaatatctcttagttgaggtgttaagaaatagcagaatgccccaaggattactgataggtggtgagaaggaatttgaggggagtcagagacagggcaggttgacaaaccggacagtcacctgctgagtaattaaataaaggttatgatttattttaatgtagttgcaaaatatctggttagggtgtgtgtgtaaatatatgtgtgtgagagacagacacacacagacacaggcagagatggaagaagccaaaaggtgatgtccacaattaaatttagattaatatttgctgggattttgattggatttactttctgtcttgaaagagattaaactttaacaaaatgctttccagttcttaaacatatataattatctattttttaaaaaaggtatggtaaaggtcttaatttctgccatctcattccctctggt

SEQ ID NO: 1408 - DNA, 1511 bp, Homo sapiens
ggcggccgggccacgtcgtagcgaggcatcgaaggtaattatagagacagtaaaattcttttactctgggaaaaataaaatgctgggtgtctcacaaaatttcagaacctgatttcaaacggatcataacaaagaggagatcaaatttagcatggtggactgctcgacaggatatatttgtcaatggaatgtttccacatattataccaccaacatgagaaaaaaatgatcattgtttatttgaagcttgatgatattctaacgctgccttttctcttctcattttagagaaaaatgagcaggcggaattgttggatttgtaagatgtgcagagatgaatctaagaggcccccttcaaaccttactttggaggaagtattacagtgggcccagtcttttgaaaatttaatggctacaaaatatggtccagtagtctatgcagcatatttaaaaatggagcacagtgacgagaatattcaattctggatggcatgtgaaacctataagaaaattgcctcacggtggagcagaatttctagggcaaagaagctttataagatttacatccagccacagtcccctagagagattaacattgacagttcgacaagagagactatcatcaggaacattcaggaacccactgaaacatgttttgaagaagctcagaaaatagtctatatgcatatggaaagggattcctaccccagatttctaaagtcagaaatgtaccaaaaacttttgaaaactatgcagtccaacaacagtttctgactacaactcaaaagtttaaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttctttaaaaattgttgttatatgaattgtgtttctagcatgaatgttctatagagtactctaaataacttgaatttatagacaaatgctactcacagtacaatcaattgtattataccatgagaaaatcaaaaaggtgttcttcagagacattttatctataaaattttcctactattatgttcattaacaaacttctttatcacatgtatcttctacatgtaaaacatttctgatgattttttaacaaaaaatatatgaatttcttcatttgctcttgcatctacattgctataaggatataaaatgtggtttctatattttgagatgttttttccttacaatgtgaactcatcgtgatcttggaaatcaataaagtcaaatatcaactaaa

SEQ ID NO: 1409 - DNA, 1514 bp, Homo sapiens
  misc_feature (18)..(19): n is a, c, g, or t
  misc_feature (26)..(26): n is a, c, g, or t
cggacgcgtgggtcgacnnacgcgtngggcatcgaaggtaattatagagacagtaaaattcttttactctgggaaaaataaaatgctgggtgtctcacaaaatttcagaacctgatttcaaacggatcataacaaagaggagatcaaatttagcatggtggactgctcgacaggatatatttgtcaatggaatgtttccacatattataccaccaacatgagaaaaaaatgatcattgtttatttgaagcttgatgatattctaacgctgccttttctcttctcattttagagaaaaatgagcaggcggaattgttggatttgtaagatgtgcagagatgaatctaagaggcccccttcaaaccttactttggaggaagtattacagtgggcccagtcttttgaaaatttaatggctacaaaatatggtccagtagtctatgcagcatatttaaaaatggagcacagtgacgagaatattcaattctggatggcatgtgaaacctataagaaaattgcctcacggtggagcagaatttctagggcaaagaagctttataagatttacatccagccacagtcccctagagagattaacattgacagttcgacaagagagactatcatcaggaacattcaggaacccactgaaacatgttttgaagaagctcagaaaatagtctatatgcatatggaaagggattcctaccccagatttctaaagtcagaaatgtaccaaaaacttttgaaaactatgcagtccaacaacagtttctgactacaactcaaaagtttaaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttctttaaaaattgttgttatatgaattgtgtttctagcatgaatgttctatagagtactctaaataacttgaatttatagacaaatgctactcacagtacaatcaattgtattataccatgagaaaatcaaaaaggtgttcttcagagacattttatctataaaattttcctactattatgttcattaacaaacttctttatcacatgtatcttctacatgtaaaacatttctgatgattttttaacaaaaaatatatgaatttcttcatttgctcttgcatctacattgctataaggatataaaatgtggtttctatattttgagatgttttttccttacaatgtgaactcatcgtgatcttggaaatcaataaagtcaaatatcaactaaa

SEQ ID NO: 1410 - DNA, 1474 bp, Homo sapiens
  misc_feature (18)..(19): n is a, c, g, or t
  misc_feature (26)..(26): n is a, c, g, or t
cggacgcgtgggtcgacnnacgcgtngggcatcgaaggtaattatagagacagtaaaattcttttactctgggaaaaataaaatgctgggtgtctcacaaaatttcagaacctgatttcaaacggatcataacaaagaggagatcaaatttagcatggtggactgctcgacaggatatatttgtcaatggaatgtttccacatattataccaccaacatgagaaaaaaatgatcattgtttatttgaagcttgaaaaatgagcaggcggaattgttggatttgtaagatgtgcagagatgaatctaagaggcccccttcaaaccttactttggaggaagtattacagtgggcccagtcttttgaaaatttaatggctacaaaatatggtccagtagtctatgcagcatatttaaaaatggagcacagtgacgagaatattcaattctggatggcatgtgaaacctataagaaaattgcctcacggtggagcagaatttctagggcaaagaagctttataagatttacatccagccacagtcccctagagagattaacattgacagttcgacaagagagactatcatcaggaacattcaggaacccactgaaacatgttttgaagaagctcagaaaatagtctatatgcatatggaaagggattcctaccccagatttctaaagtcagaaatgtaccaaaaacttttgaaaactatgcagtccaacaacagtttctgactacaactcaaaagtttaaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttctttaaaaattgttgttatatgaattgtgtttctagcatgaatgttctatagagtactctaaataacttgaatttatagacaaatgctactcacagtacaatcaattgtattataccatgagaaaatcaaaaaggtgttcttcagagacattttatctataaaattttcctactattatgttcattaacaaacttctttatcacatgtatcttctacatgtaaaacatttctgatgattttttaacaaaaaatatatgaatttcttcatttgctcttgcatctacattgctataaggatataaaatgtggtttctatattttgagatgttttttccttacaatgtgaactcatcgtgatcttggaaatcaataaagtcaaatatcaactaaa

SEQ ID NO: 1411 - DNA, 1856 bp, Homo sapiens
  misc_feature (18)..(19): n is a, c, g, or t
  misc_feature (26)..(26): n is a, c, g, or t
cggacgcgtgggtcgacnnacgcgtngggcatcgaaggtaattatagagacagtaaaattcttttactctgggaaaaataaaatgctgggtgtctcacaaaatttcagaacctgatttcaaacggatcataacaaagaggagatcaaatttagcatggtggactgctcgacaggatatatttgtcaatggaatgtttccacatattataccaccaacatgagaaaaaaatgatcattgtttatttgaagcttgatgatattctaacgctgccttttctcttctcattttagagaaaaatgagcaggcggaattgttggatttgtaagatgtgcagagatgaatctaagaggcccccttcaaaccttactttggaggaagtattacagtgggcccagtcttttgaaaatttaatggctacaaaatatggtccagtagtctatgcagcatatttaaaaatggagcacagtgacgagaatattcaattctggatggcatgtgaaacctataagaaaattgcctcacggtggagcagaatttctagggcaaagaagctttataagatttacatccagccacagtcccctagagagattaacattgacagttcgacaagagagactatcatcaggaacattcaggaacccactgaaacatgttttgaagaagctcagaaaatagtctatatgcatatggaaagggattcctaccccagatttctaaagtcagaaatgtaccaaaaacttttgaaaactatgcagtccaacaacagtttctgactacaactcaaaagtttaaatagaaaacagtatattgaaagtggtgggtttgatctttttatttagaaacccacaaaatcagaaacacagtacaaataaaacagaaatcaaactataagttgacttttagttcctaaaaagaaacatatttcaaaagcaatggaatctagaattcttataacatgaataacaaaatgtacagcaagcctatgtagttcaattaatatataaggaaaaggaaggtctttcttcatgatacaagcattataaagtttttactgtagtagtcaattaatggatatttccttgttaataaaattttgtgtcataatttacaaattagttctttaaaaattgttgttatatgaattgtgtttctagcatgaatgttctatagagtactctaaataacttgaatttatagacaaatgctactcacagtacaatcaattgtattataccatgagaaaatcaaaaaggtgttcttcagagacattttatctataaaattttcctactattatgttcattaacaaacttctttatcacatgtatcttctacatgtaaaacatttctgatgattttttaacaaaaaatatatgaatttcttcatttgctcttgcatctacattgctataaggatataaaatgtggtttctatattttgagatgttttttccttacaatgtgaactcatcgtgatcttggaaatcaataaagtcaaatatcaactaaaaaaaagaaaaaaaaaagaaaacaaaagaaaaaaaaaacaaaaacagaacaaaaagaaaaaaaaaaccggcggtggactctattttacgttcgtgggtgcgggcggacaaaaatagagtgattaatgagacggcggagcacagatggtaattagtgcggtgtgtttcgctgagcaccccgatttcttttggtgaaacaaagctggggtgaaatactatgcgcgcggggctccccccgaattaagtggaggcgcgtgtataaataatcttcgcgatagaaccgcacgcggtgctaccctcgctgttttttatcgtttctcttcccccaaaaacggcgggagaga

SEQ ID NO: 1412 - DNA, 491 bp, Homo sapiens
tggtgattttgacccatgaaaataaactgatttctcctctacttttagatggtccagtagtctatgcagcatatttaaaaatggagcacagtgacgagaatattcaattctggatggcatgtgaaacctataagaaaattgcctcacggtggagcagaatttctagggcaaagaagctttataagatttacatccagccacagtcccctagagaggtaactacctgacaatgacaggaatggaaatcagttcatccctgcaagggcattaatatctgtcaagcatccataagtgccaggcactttacatccagtatctcctaaaatgctataaattcagtattgctaaccttattttacagataagaaacctgagactctgagaacttgtccagtgtcacacagccattaagtggtaaagttaagattcaaaattaaatctatctggctccaaagcttctccccattaaattatcttgatttctaggaaac

SEQ ID NO: 1413 - DNA, 526 bp, Homo sapiens
taacaaaaagactttaaaaaactacatcaaaatactaatagtggtaatttattaatagggagattataggactatggttctgaataatatttattaaattatattttcaagtctacactatttgcacaatttttataatttaaaaaatttaaatagtaaaaataaaatgtaaaatatcacaggaaaataactttccaaccaaagccacacacaaatggaatgtaaatatattttggtgtcattttcaagataatataattttacttagttcaacaaaaaccttgagaatatttagcccaatcagtgctttttgtttcttttcaaagccttactttggaggaagtattacagtgggcccagtcttttgaaaatttaatggctacaaaatgtgagtattgcgtatctgtcatctttgaataactagcgagttccattcttagaggtaaaggtgggggtgccagatgatgaatgtatgctattcttctcacagccttctaactggcaactgacacagttaaaaaaagaa

SEQ ID NO: 1414 - DNA, 305 bp, Homo sapiens
aatagacatggtttaaaacaccttctaatgcaaagtagaagatttacaatgctgcttcattgtcaggttccagtgtcctccttttatccaacaaaatctaaagagttatctcattggaattttcagcttcagtgaaaattctgtgatgatctcaaatgttgctgcataaaatgtataattaatggagtgaagtggtttgtaaagaaacattttattagaacaagtgagggtaaatgaactaatagagttcaattctatgcttcaatttccaatataatatgcaaatatctactctgcaaaaccgt

SEQ ID NO: 1415 - DNA, 247 bp, Homo sapiens
ctataaagaaatattatattaatgaatgtgaaataagaactaatccgaagagcttctgtggactctgagaagagcattatatcttccccctgacctttgcaaacgaatcaggtaaataccgatttaaaaaaatgttatttcagaccttggatgaaaatcatcattatgtacctatcataaactcagagaaaaatgaacaactttggttgttattaaaagcatgtggaaaaaagaactgtaatattct

SEQ ID NO: 1416 - DNA, 326 bp, Homo sapiens
gattctgcatggatactgatagtctattcacaagagaacaaattacattattctttagctacagaattttctgcagttttggacatataaaaagatatctactgattcccatgataaacattaccagtatcactgcaaacatgcagcatctcttttatccaaattagaagctcacatatgagggaaaattaaaattctgttggtattaaaagatgtttaagatttttttcaatacctgtagatgttgattctatatagctttattttattttatttttcattttttgagacagagttttgctcttattgcctaggctggagtgcag

SEQ ID NO: 1417 - DNA, 355 bp, Homo sapiens
gtcgacgtatgacaggcataaacccaggccacactccatttctatggttaggtggaattagctccaatgtctgatgcccagttccctcccacggcaggtacatttgccacatcccaatacactgccagtaaagataaagtaccttctaatatacttataaaagcacagagtcgaggggctagggactatagaagaaggcaggaggcaaggaagcaaagggttttatttttttttaatgtccccaactcctctagcctggtccctttgctttgtttggctggtacgacaggtggtgactcttaagcactgtgtagcctgctcttgtgtccagattatcccaagcagtctgaaactt

SEQ ID NO: 1418 - DNA, 551 bp, Homo sapiens
cacctttgctttcatgcttcattgtacatggtgaaatgtgttacagcatatgtgtatgtgtgtttaatagatccttcttttttcttcagagaagttgaaggtggtaggtagtagaaactgtcttgcagggtttataacaggtgcaggcaagtagaagttcccctgagatagctgccttttaagaatcttatgtttaaaccatgatgatctgatttaaggcccattatcaatagtctgctacttatatctgcatgatcgtggactgattgatactgactttgtagccatgtgctccataatgcgctgtcaggaaatgctgacagatgcaatgaaagaacaataaatgtggggcagccgtaaggtaaaggttccagctaggctgtatgaaaactgatagctaggatattggctcctatgttaccatatacaccagtacctttgagagtttagctggtgagtgaattaaaatggtctcctgatacccaggaggggggaaaataatcttcatttaaggaacttgccgactttgccaaaacattgctttataagaa

SEQ ID NO: 1419 - DNA, 386 bp, Homo sapiens
  misc_feature (15)..(15): n is a, c, g, or t
  misc_feature (36)..(36): n is a, c, g, or t
  misc_feature (297)..(297): n is a, c, g, or t
cccttttcccgaccnatatgccatatgcctaggacngatttttgtatgacaatagattgaagtgaagaagaagatatgaggccctggagccaggtgtcacgccctataatccccagacatgcttcttttaagaggtggctagaatgaggatattatgttctctaggccatacaaagctattttgtgatttttattttctttaggacagtggttctctgttggtccattaactacggggaggtttccaacacccttcaggggttccatgagatgcaaaaaaaagataagttgaactgntgacttcgcatgaatctagacagtggtaccaagttataccaatagtcattgtattcttcactgctacacactcacagattaaaaaaaaa

SEQ ID NO: 1420 - DNA, 445 bp, Homo sapiens
ggcctgtaaccctagctactcgggaggtggaagcgggagaatcgcttgaacccaggaggcggaggttgcagtgagccgagattgtgccactggactccagactgggcaacagaacaaaaactctgtctcaaaataaataaataaataaataaataacttcttaacccaacaaggctacaaatgagttgtccacaggccagactggcctgcttctgctgaccttcattgaattgtaaaagataactcaaagtggtcgccaatatttacagattgggagtttgttgctttcgggagtttttcattttttgagataaggtcttgctctgtcactcaagctggagtgcaggggcatgatcatagctcactccagcctcgaccacctgggctcaagagatcctcctgctccaacctcctgagtagctaggactacaggtgtacaccacca

SEQ ID NO: 1421 - DNA, 495 bp, Homo sapiens
tgtacaaagatgtacttctgaaaacctaagtttaagtcaacttttgtgagttgtataatttcaaatatcttagctaggtgtgttagagaaattctgtgataattttgtagaacaaaggctctgtaattttctaattttattaattatataaatctagagatcttaagttgggtttgcttaaagtgaagcatactttttgttgcctgttttgcatttagggtattaaacttagttgtacagtctgtttaatttaggttactaaatttattccccttattatagcactcttaacttccattgttccaaaggaaaatttaatgctgaggaactttgccttgatgaaaatgtggttttttaaaatacccaggtataggccaggtgtggtggcttatgcctataatcccagtactgtgggaggccaaggcaggaggatcacttgacgctaggagtttgagaccagcctgggcaacatagcaagaccccattactacagaa

SEQ ID NO: 1422 - DNA, 332 bp, Homo sapiens
ttgctttttttcctctctttcattgtcctcagttgctggttgtttctttattttgctcattcatatattttgcttaaaaaactattgtttatttgtttaaaaaacaacttttttattggcataagaaaaacttgaaccatagatgatgtaacaatctttaatttttcatcagtgttagctgttcctctttatttaacatttgtatttcatgtcctgctaatcaattttataagtttagcgatttttcattgtaaacctacctcatgtattatgtattgatattttgtaaaaaatttgctttggagaaatctcacagtttttctgggtcgacg

SEQ ID NO: 1423 - DNA, 294 bp, Homo sapiens
gatcatatcactacctatggatatggatgtgattgaaatgacagacaggggagaattttttttaacttactagccatgtaatgattttttaaaatttattgctagaaaatcttcactattaccaaacttgcctcaataaatgatgttacgtataaatagcaacagcgatgtcagaagacctccttagcatttcttttcctggtatgatatggctgtctgtaagaagagagtaaacatagatagctcttgcttcttacggtatttcagaatccccctagaagttttttatattaa

SEQ ID NO: 1424 - DNA, 405 bp, Homo sapiens
accaaatctaacgatatataaaaatgagtacatcatgaccaagttgggtttattctcagaaataaaaatattggttaacgttaaaagttcaataaattgagtattcatattgctagatatgaggaaagtcatataatcaattgattcagggaaaaatatttgataaaatccaacatctgttcataattaggaaaaacactgttgaaaactgaggaatagaaaagaacctttttaggataaaggatatctaaaacaaaataaacaaaaaacctgaatgggatgttggaagctttctcttttggatcagtgtttattatgttttcattttcagtatcttatgatgtcttgacttcttaaaaatcttgctggccaaggagagactgccctcccagggctagctaattt

SEQ ID NO: 1425 - DNA, 400 bp, Homo sapiens
ctccctgcaacctcaccctcctgggctcaagcgatcctctcgctttggcctttagagtagctgggaccaatggcacgtgccaccacgcccggctaatttttttattttttgtggagacaggggtctcgctatgtttcccagattggtctcgaactcctgggctcaagcaatcctcctgacttagcctctcaaagcgctgggattacaggtatgagccaccacacccagccaagatccttgataatattaaaaatatttagtatataaggtatacccaggcagtgatgagaagggagggtttcaggggtatcaaccttgaagggttaggaggactggagggtcctgatgagagttcaggaagcagcgagtggccccagaccagtgcatgcaggtgacacat

SEQ ID NO: 1426 - DNA, 431 bp, Homo sapiens
actcccaggtacagccctgctggcccccaaaggcagagccggccgggcgcggtgcatgctgggactcggcgctcggaagcggaagccgctccgccccatagcgccccctgcgggcgggaggagcggcgccgccagagggagtcggtcctcagaggaggggcccgggcaccctccgtgcgggccgcagcacgccggtctttgagggacccttggactcccggatctgcatgcgagggatgcggtcgaagacgagatgagggagctgacgggaggggaaacggaggggcaggtgaacatggagagagcaggaacagggagagagtagggacagcgactgggagacgcgctccacagaaacccggactgagaggcagcgagagggtgagagtccggtgctgttccttccaaagctgcccccaagtcagggatga

SEQ ID NO: 1427 - DNA, 392 bp, Homo sapiens
gaaaatcagctattgtaatccaccatgtcaataggctaaagaaacaaattcatatgatcatgtcacttaatgcaaaaaaagcatttgataaaacccaaggcctagtcattataaaaattcttggctgccaggggtggtggcttatacctttaatcctaacactttgggatcatctcactcatggggcgtgcattctactcatttatttctcagaggatccaggcatggtggctcacgcctataatcccagctacttgggaggctgaggcatgagaagcacttgaacctgggaggcagaaagtgcagtgagccaagatcgtgccactgcactccagccttggcgaaagagcaagactccatctcaataaatacatacatacatacataaaaat

SEQ ID NO: 1428 - DNA, 433 bp, Homo sapiens
gtttgcctggggctgttcataaggaactaggagcagaaatctggcatgtgattcttacagacatctcaaacgttgatccttcctgaaggagcctagctggagaagagcagaaacggggcagatgcctctaggcaggccttgactgatttaaagtcccagtcctgggcttcactcgattaagggtttatcagaccttcccacccatattaaagccatgtttctgggaccccgcagtgacagccgtttcttcccaaagacccctctggtgtgttaagatgtgagctggaagtgagcaactcaaaaaccaagtcatggtaaagaactgtaggttttggggccaggctcggtggctggctcatgcctataatcccagcactttgggaggctaaggcaggaggatcgcctgagctcaggagttcaagaccagcctggg

SEQ ID NO: 1429 - DNA, 470 bp, Homo sapiens
tgatatccctcaactgcctgttgtgagcttttgtttttaagtctctgaacctttaagtggaggcttcagaattaaagcagaatttcaggtgtcacaatttctctgagcatgacaaattggaactgacatcatttgaggttaatcaaagctcctgtggtttttaagtgtttcacgaggaaggcaaagagaaagggatggagaggaatgtattctaccagccataagcctagtgcttggtgggtgatggcctagagatagactatttgggagcccctgagtggccacctgtatcttgctgtcaatacatgcttgctctgcagtcagtctgttactatctccttctccattccagtataggatgtaaagaccagtgaagcataattgaaagtgcttggagctaatggccatctatgcacttactctctgctctcaactgtagtttttctgaaattcttgcagttgaatttagt

SEQ ID NO: 1430 - DNA, 269 bp, Homo sapiens
agtaagcaaaagctgttaaatgaaaaaaaaaaaagacctcttttaaaaaagggagggaatataagtttgaaaaaataaatcttcaaaatttgacgtgaggataggaaagagaaaagttgaacctcaggaattaataaaaacgaaaaggagggtcaatcctggaggttgactatctaagcaacagaacttatagtaatatgaattgtaggaattacagacaaaataataaaaaaatctcaaagtgattatcaagagtatatacagtggac

SEQ ID NO: 1431 - DNA, 417 bp, Homo sapiens
  misc_feature (307)..(307): n is a, c, g, or t
  misc_feature (318)..(318): n is a, c, g, or t
  misc_feature (327)..(327): n is a, c, g, or t
  misc_feature (359)..(359): n is a, c, g, or t
  misc_feature (369)..(369): n is a, c, g, or t
  misc_feature (395)..(395): n is a, c, g, or t
caaaaatcaagataggagttgcctctgagtggggtgaaaggggatgggacgagagagggagcgcacgggaattgataatgttctagttgttggattcggcagtatgttttgttttttttccatctccccccaacacacataatgtagttttattcagttttaaacaaactgtaactcttttggggcagtaagttcatgagtgttcattttattgttaggctttagaactcccatctgtattatgtatgtattattatatattacataatacattatatatagagagagagaatgtttcaaatatttnccatggatatngatgggggncccgggaaggaggaggggggggttggcctttncccggtcctnccccccttgggaggggcaagtcttgngcccccggggcccccgggggtt

SEQ ID NO: 1432 - DNA, 427 bp, Homo sapiens
tatttccatttggtctaaggcttgggagagggctctagagttggtttaaaaaagctgcctagtggctggagggagaggcttaggcagagcggggctcttcagatgtcgctgggttcggtaggctcccgtgtgcctgagggtgaacctttttgcccagcccggcctggaggccggctggcctgtgaaggttggtcaggtggtcacctatcttcttgatgagttttactttttcatctaggaagtggctctccaggaagtcacagatatgggggtctgtgcaggtggaacccaaggcatgaagatccaaaagggtccagttcaggttcttctccagggccagagtgacttccatcgcacccagggttttaccccattcatctttacatggcttctggatgtccgggaagacagtgcggccgccacactg

SEQ ID NO: 1433 - DNA, 116 bp, Homo sapiens
gtcttttaggtttcactggtgatacactgccatcacagttccatgcaatggatcctacttagtccatagacttttgaggcagatgtaattgaactaaatcattcaaggtcacttga

SEQ ID NO: 1434 - DNA, 590 bp, Homo sapiens
actactaagctaagcactctacacattactttatttaacacgcacaacagagttgtgttatttagggactgttgttatgccttttatagatgaggagattgaaactcacagaggccacgtatctaagcattttctcaagctcaccttgctattaaggggcacagcctggattttaactcaggcattctgatgctacagctgtgatctattcaacattgtgttatattctctaatttgtcatttcgtggctttctagttcatgaaactgtagtaaatattttaaatctgcttttagaagttctgaattgaatatttttattaggaatacagtgtagccttttattaatatggtctcaaattgtaagaacataaagtaaagccagaaacgtaggttgaaacagaactcccagatccatgagttcagataaattattgtatagttttctaaaatacacaggaatgatttttcttttttttagatgtctaaaaaaatgtgctatctgtagttattaaattgtcattgctaaataaaggttgcctttgttgtccagaattattagctcaattgtattcagtctgaataatcttaa

SEQ ID NO: 1435 - DNA, 383 bp, Homo sapiens
taaattaaggttcataatcaaggagtcacagtttgctccttgaaagcaaactctcagtaatcaaaattactttgtgagccccagatttatacagccaccttctttctgtacttttttatttggaaatgcagcaggcgcctcaatgtaacatgttctaaactgggaagcaacagaatgtagccaacaagcactgcctttgtagtcaggcaatttgaacaccaatgccgccttagccacttacggtttcttgtaccatatcatgcgcagaaatttgacaaattggggtaagaccgtttaactcgaagtctttatgcaaattaaatgggaatatacatgacaaatgaagggaagtagacagatgattacctagcacactagggtac

SEQ ID NO: 1436 - DNA, 372 bp, Homo sapiens
atattttaaatcctatcttacctatccataggttacatatttgactctcaggaacacaggtaactcattgcctggaaccatagctctgagccccaaaggcatcacaaagtgattctagttagtgtcttgaagcttatgagctttgctgataagcagcatcacagtaaaagcaatatttgtttttagatttagtttttttttttttttcatttaactaagagccttcaactgtactatcttcttgggtgtttgatatgggcaggacatctatcattgattcctattagagatgataaagcaaacattcaaagagactgtgaaactaaatgttgcacagagatagagccagggttacaactctgatcttctgtg

SEQ ID NO: 1437 - DNA, 169 bp, Homo sapiens
gttcaagcaatcctcctgcctcagcctcccaagtagctgggactataggcatccaccaccacacccagacccctcttcttttcctggtactacatttacagtctggtctctgaatccatgggttctgcatccatagatttaaccaatcacagattgaaaatatttgggg

SEQ ID NO: 1438 - DNA, 246 bp, Homo sapiens
tcctggttcatagatggccccttcttgctgtgtcctttcatggtgagggtctttctcaagcatcatgttttataacatcactaatcccatgggtgagggaggagcctttatgtcctaatcaccttccaaatacctcacctcctaatatcatcaccttagggttgggatttcaacatatgaattttgatggaacacaagcattccaatcacagcagtcatcctcatataaactttcaaagaaataaa

SEQ ID NO: 1439 - DNA, 742 bp, Homo sapiens
tgccctgtgctggatgtggccctcaccccctaccccagacctcaccctccaccccccacccccagttctgccttgggcctcttctccttttccaagttcagctttttattaagcagaaactatccaagacccagttctgaccgttgagggaagtcaagttggaggggcagtgttgtgtagcctggcttacaggctggctctccttgcgccagctgtgggacacttagcaagttgcataacctctcatctgggaaatgaagataacaatgcttacccccaaagagctattttcatgattagccagaaataaagtaagtgctgtgtaaatgtttattgagcagcctgtgtttgttggatttaaaagaagagagtgagtcttttaaacaaaaagccctcccataaccagcagccctaagtggggctctgggacaaaaaaaaaaaaagttttctggtatcctggcttgggggagggaacaggtagacaatttttgtattttttagtacagacggggtttcaccatgttggccaggctggtctcaaacttgcttccccagaactcaggcgctgcttctgtcttagtggagtgagtgcttgccagctgtggcgggcgtggcactctggtgttcatcttctgtgatggtgccgtggatttaactaagccaaccacaggatatagtgaaatatgtgttgacttctctgcttttttggtgacgggctgtgtggggaggggtggtaaataat

SEQ ID NO: 1440 - DNA, 4411 bp, Homo sapiens
aggagcatgcggagaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccagcaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtacgtttgcgggagcacatgggtgaaaagtatacaacttacagtgtgaaagctcgccagttgaaattttttgaagaaaacatgaatttttgagcatttgtcctaatctgctgccagaattaaagacctatttttagaggattttggcttaaaaagcaagggcaaacagtcatttggaagccactcaccactgttttatatctcttttttatatctctttggcgtttccctacagaaaagaaattggacagaacagaataatatgaagcaggatcacaaaagaaaaaaaactttggctttcatattctctttgtgaggacaaatctgttgtttgtttgattactgtttactgagccttaatccaccaagtttatatttagaattttatttttttaaggtactaattaacttaaacacagagctataaaatgctggattgaaaattttatattgtaatgtagagataaaagcagtaggagaaacaaatgacataatatgtcgtcataattcctgctattgttaataaccttaaggagtagttgataaattataaaattttaaaaagtcaattcagttctagaaatagatttaaagaatatgaagttctatctagtacttgagcagctgtatttcttttctacacattgatggacttttaatattttattctcatttaatataaacctcatctagggtatatacaaattaaaactgagacacattggctttgtaaatcagtatgtttttacataatggttttgttagatttatttttccatcagtgaaaacatttcttaaacacaaatttcatttccatttaagcaatttgtaagcaaagtccaggtccatttagtttttggatatatttaatgtttgtctcctgaagtttgtcttcatgtactgtaagatattagttgtctttccatgttttaaatgtatgattatatagcacatattttattagttgtttaataagaggtaatacccatctaggaaagaaattttatgaagttaaatacaagtcttgaatagtacattttcacttctgtattcgagggactctaaaaataaatattgctccagaaaaaaaaaaaaaaaaaaaaaaaaaaaaaaaaaaaaaaaaaaaaaaaaaaaaaaaaaaaaaaaaaaaaaaaaaaaaaaaaaagagagggcaaccagcttaaatctattaccacagagagggggcccaaagagaggacagtcaaactatgaattagaagacaagaagcgccgccatataagaagtcggctgttaacttaaaacaaaagcggagcaggccgggcatatcaagaaaaaggcgcacgtcaaacactgcggggtaagccatcaaataggtcgacaacgacaaccacacattgatttgaggtggccgacacagacaaaggtgacacactccacggagcgtatagagggataaacgaggagcaaaatagatgtagcgggaaaagtcgggtacccgcgagaagtgactcggcacgtcagtatccagtaggtgaggagtagacttgagaaacacttcacagggagggcaggcagaaagcagcagagagcagccgccagcaacgcgagcggagaacggagagtagcgcaaaagcaggtacgtcaggagacacggcgaaggcaacaagacgcagagcaacagaggcgagcggcgagcggcgtaggtcaacgagagaagacgacagcatccacgaggaaggacgcgagcactcaagatccaagtagatctagcgagcctcgtcatattatg

SEQ ID NO: 1441 - DNA, 1574 bp, Homo sapiens
aggagcatgcggagaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccagcaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccag

SEQ ID NO: 1442 - DNA, 690 bp, Homo sapiens
gcacacctgtagtcccagccactcgggaggctgaggtggaaggatcacttgagcccaagaggttgaggctacagtgagttgtgttcacaccactgtgctttagcctaggtgacagagcaagactctgtctcaaaaatataaataaataaataagtaaataaataacagaactttctaagggcttgcactaggcagcactttgctcaatctgctgtgataccaacatacccatctgtgtcgccagatttgagtctcacttgctaatcattcctcagtttcttatttgtgtcaatgtagtttaccttcttgcctgtagatgatgtagggacaccatctggtggctaaatgggtaattactaggtttctaacccatgttcacctctctgtataatactctgggaattcttcctgttctttgaaagtattggatgtattatttctttaactatatcatttagttatttcactaatagaggctgccttccatatctcagagttgtaaggtttatgtgtatttttaggtgatcctttaaagcactttaacagtctcacattaagagcaagctgaagctgggcatggtggcttgtgggtgttatctcagctacttgggaggccaaggaaggaggattgcttgagcccaggagtttgtggccagcctggacaacatagtgacacccctgtatccaaaa

SEQ ID NO: 1443 - DNA, 659 bp, Homo sapiens
cgagatcgtgccactgcactctagcctggcgacagagcaagactctgtctcaaaaaaacacaaaaatcaaaacaaaaaaaaaacaaacaaaataaaaaacttcatctgatgttcttcagttattcttgtggactttatgagtgaactgggatatcacgggtaaaatcacttcaatgtttttttctttttgccacaaatcatatgggaacaatttttgtatttgttagattctcctgttatattgcacctaggaacgtattgtgtctagttgttgcatctaagactggttcaagtatcacattctggttgtgttgtcatgtagaattttaattcttccaaacatttaagaaaggaaacagattcattgtctgtctgaggatgagttaagttcttctacaagttcaactgataagtcagatggggattacggggaagggtaagttcttgtttttctgtctccctttataaactatttctgttttaatgaatattaaatgtgcattttcagtagtatttagatctctagtattcccactgataaaattataaatggtttgtggcatatgctggagctaaaagtgtctcttcttttttttttttttttttttttgagacggagtttcactctagcctgggtgacagagcaagactctgtctca

SEQ ID NO: 1444 - DNA, 4347 bp, Homo sapiens
aggagcatgcggagaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccagcaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaagaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtacgtttgcgggagcacatgggtgaaaagtatacaacttacagtgtgaaagctcgccagttgaaattttttgaagaaaacatgaatttttgagcatttgtcctaatctgctgccagaattaaagacctatttttagaggattttggcttaaaaagcaagggcaaacagtcatttggaagccactcaccactgttttatatctcttttttatatctctttggcgtttccctacagaaaagaaattggacagaacagaataatatgaagcaggatcacaaaagaaaaaaaactttggctttcatattctctttgtgaggacaaatctgttgtttgtttgattactgtttactgagccttaatccaccaagtttatatttagaattttatttttttaaggtactaattaacttaaacacagagctataaaatgctggattgaaaattttatattgtaatgtagagataaaagcagtaggagaaacaaatgacataatatgtcgtcataattcctgctattgttaataaccttaaggagtagttgataaattataaaattttaaaaagtcaattcagttctagaaatagatttaaagaatatgaagttctatctagtacttgagcagctgtatttcttttctacacattgatggacttttaatattttattctcatttaatataaacctcatctagggtatatacaaattaaaactgagacacattggctttgtaaatcagtatgtttttacataatggttttgttagatttatttttccatcagtgaaaacatttcttaaacacaaatttcatttccatttaagcaatttgtaagcaaagtccaggtccatttagtttttggatatatttaatgtttgtctcctgaagtttgtcttcatgtactgtaagatattagttgtctttccatgttttaaatgtatgattatatagcacatattttattagttgtttaataagaggtaatacccatctaggaaagaaattttatgaagttaaatacaagtcttgaatagtacattttcacttctgtattcgagggactctaaaaataaatattgctccagaaaaaaaaaaaaaaaaaaaaaaaaaaaaaaaaaaaaaaaaaaaaaaaaaaaaaaaaaaaaaaaaaaaaaaaaaaaaaaaaaagagagggcaaccagcttaaatctattaccacagagagggggcccaaagagaggacagtcaaactatgaattagaagacaagaagcgccgccatataagaagtcggctgttaacttaaaacaaaagcggagcaggccgggcatatcaagaaaaaggcgcacgtcaaacactgcggggtaagccatcaaataggtcgacaacgacaaccacacattgatttgaggtggccgacacagacaaaggtgacacactccacggagcgtatagagggataaacgaggagcaaaatagatgtagcgggaaaagtcgggtacccgcgagaagtgactcggcacgtcagtatccagtaggtgaggagtagacttgagaaacacttcacagggagggcaggcagaaagcagcagagagcagccgccagcaacgcgagcggagaacggagagtagcgcaaaagcaggtacgtcaggagacacggcgaaggcaacaagacgcagagcaacagaggcgagcggcgagcggcgtaggtcaacgagagaagacgacagcatccacgaggaaggacgcgagcactcaagatccaagtagatctagcgagcctcgtcatattatg

SEQ ID NO: 1445 - DNA, 4273 bp, Homo sapiens
aggagcatgcggagaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccagcaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtacgtttgcgggagcacatgggtgaaaagtatacaacttacagtgtgaaagctcgccagttgaaattttttgaagaaaacatgaatttttgagcatttgtcctaatctgctgccagaattaaagacctatttttagaggattttggcttaaaaagcaagggcaaacagtcatttggaagccactcaccactgttttatatctcttttttatatctctttggcgtttccctacagaaaagaaattggacagaacagaataatatgaagcaggatcacaaaagaaaaaaaactttggctttcatattctctttgtgaggacaaatctgttgtttgtttgattactgtttactgagccttaatccaccaagtttatatttagaattttatttttttaaggtactaattaacttaaacacagagctataaaatgctggattgaaaattttatattgtaatgtagagataaaagcagtaggagaaacaaatgacataatatgtcgtcataattcctgctattgttaataaccttaaggagtagttgataaattataaaattttaaaaagtcaattcagttctagaaatagatttaaagaatatgaagttctatctagtacttgagcagctgtatttcttttctacacattgatggacttttaatattttattctcatttaatataaacctcatctagggtatatacaaattaaaactgagacacattggctttgtaaatcagtatgtttttacataatggttttgttagatttatttttccatcagtgaaaacatttcttaaacacaaatttcatttccatttaagcaatttgtaagcaaagtccaggtccatttagtttttggatatatttaatgtttgtctcctgaagtttgtcttcatgtactgtaagatattagttgtctttccatgttttaaatgtatgattatatagcacatattttattagttgtttaataagaggtaatacccatctaggaaagaaattttatgaagttaaatacaagtcttgaatagtacattttcacttctgtattcgagggactctaaaaataaatattgctccagaaaaaaaaaaaaaaaaaaaaaaaaaaaaaaaaaaaaaaaaaaaaaaaaaaaaaaaaaaaaaaaaaaaaaaaaaaaaaaaaaagagagggcaaccagcttaaatctattaccacagagagggggcccaaagagaggacagtcaaactatgaattagaagacaagaagcgccgccatataagaagtcggctgttaacttaaaacaaaagcggagcaggccgggcatatcaagaaaaaggcgcacgtcaaacactgcggggtaagccatcaaataggtcgacaacgacaaccacacattgatttgaggtggccgacacagacaaaggtgacacactccacggagcgtatagagggataaacgaggagcaaaatagatgtagcgggaaaagtcgggtacccgcgagaagtgactcggcacgtcagtatccagtaggtgaggagtagacttgagaaacacttcacagggagggcaggcagaaagcagcagagagcagccgccagcaacgcgagcggagaacggagagtagcgcaaaagcaggtacgtcaggagacacggcgaaggcaacaagacgcagagcaacagaggcgagcggcgagcggcgtaggtcaacgagagaagacgacagcatccacgaggaaggacgcgagcactcaagatccaagtagatctagcgagcctcgtcatattatg

SEQ ID NO: 1446 - DNA, 4176 bp, Homo sapiens
aggagcatgcggagaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccagcaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagagaaaagaaattggacagaacagaataatatgaagcaggatcacaaaagaaaaaaaactttggctttcatattctctttgtgaggacaaatctgttgtttgtttgattactgtttactgagccttaatccaccaagtttatatttagaattttatttttttaaggtactaattaacttaaacacagagctataaaatgctggattgaaaattttatattgtaatgtagagataaaagcagtaggagaaacaaatgacataatatgtcgtcataattcctgctattgttaataaccttaaggagtagttgataaattataaaattttaaaaagtcaattcagttctagaaatagatttaaagaatatgaagttctatctagtacttgagcagctgtatttcttttctacacattgatggacttttaatattttattctcatttaatataaacctcatctagggtatatacaaattaaaactgagacacattggctttgtaaatcagtatgtttttacataatggttttgttagatttatttttccatcagtgaaaacatttcttaaacacaaatttcatttccatttaagcaatttgtaagcaaagtccaggtccatttagtttttggatatatttaatgtttgtctcctgaagtttgtcttcatgtactgtaagatattagttgtctttccatgttttaaatgtatgattatatagcacatattttattagttgtttaataagaggtaatacccatctaggaaagaaattttatgaagttaaatacaagtcttgaatagtacattttcacttctgtattcgagggactctaaaaataaatattgctccagaaaaaaaaaaaaaaaaaaaaaaaaaaaaaaaaaaaaaaaaaaaaaaaaaaaaaaaaaaaaaaaaaaaaaaaaaaaaaaaaaagagagggcaaccagcttaaatctattaccacagagagggggcccaaagagaggacagtcaaactatgaattagaagacaagaagcgccgccatataagaagtcggctgttaacttaaaacaaaagcggagcaggccgggcatatcaagaaaaaggcgcacgtcaaacactgcggggtaagccatcaaataggtcgacaacgacaaccacacattgatttgaggtggccgacacagacaaaggtgacacactccacggagcgtatagagggataaacgaggagcaaaatagatgtagcgggaaaagtcgggtacccgcgagaagtgactcggcacgtcagtatccagtaggtgaggagtagacttgagaaacacttcacagggagggcaggcagaaagcagcagagagcagccgccagcaacgcgagcggagaacggagagtagcgcaaaagcaggtacgtcaggagacacggcgaaggcaacaagacgcagagcaacagaggcgagcggcgagcggcgtaggtcaacgagagaagacgacagcatccacgaggaaggacgcgagcactcaagatccaagtagatctagcgagcctcgtcatattatg

SEQ ID NO: 1447 - DNA, 3369 bp, Homo sapiens
aggagcatgcggagaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccagcaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtacgtttgcgggagcacatgggtgaaaagtatacaacttacagtgtgaaagctcgccagttgaaattttttgaagaaaacatgaatttttgagcatttgtcctaatctgctgccagaattaaagacctatttttagaggattttggcttaaaaagcaagggcaaacagtcatttggaagccactcaccactgttttatatctcttttttatatctctttggcgtttccctacagaaaagaaattggacagaacagaataatatgaagcaggatcacaaaagaaaaaaaactttggctttcatattctctttgtgaggacaaatctgttgtttgtttgattactgtttactgagccttaatccaccaagtttatatttagaattttatttttttaaggtactaattaacttaaacacagagctataaaatgctggattgaaaattttatattgtaatgtagagataaaagcagtaggagaaacaaatgacataatatgtcgtcataattcctgctattgttaataaccttaaggagtagttgataaattataaaattttaaaaagtcaatcggtcttgaaatgaataagaattgaggtctcttggaatgacggggtttttccacaatggggtaattattctaaaacccttggttaatagaacgggggacaggaacggggattccagaattaattcatgacggcgatagtaaggggtgaaaaagaagggaa

SEQ ID NO: 1448 - DNA, 3255 bp, Homo sapiens
aggagcatgcggagaactgctcccggcccggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgcctgagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttagagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccagcaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggtgcattacgtactcctaagagagaaggtggacagtctacatctggcaggcctaatgcagtaaaccttttaaatgtcagctccatttatttttgggacagggccagcttgttatatcttttcactcttgataaagaaaggaactggtaaataatagtcaaaaggattatgattgacccattaagggaataaatttttcaggtactcttgtaaacaattgatagcctaattaaaaatatttcataggttggtcttaacaggacttcctggcctgatgcagtggctcacgcttataatactagcactttgggaggccaaggtgagaagattgctttagcccaggagtttgagatcaatctgggcaatatagttggaccctgtctctaagaaagtggaaggatcacttgagcccaagaggttgaggctacagtgagttgtgttcacaccactgtgctttagcctaggtgacagagcaagactctgtctcaaaaatataaataaataaataagtaaataaataacagaactttctaagggcttgcactaggcagcactttgctcaatctgctgtgataccaacatacccatctgtgtcgccagatttgagtctcacttgctaatcattcctcagtttcttatttgtgtcaatgtagtttaccttcttgcctgtagatgatgtagggacaccatctggtggctaaatgggtaattactaggtttctaacccatgttcacctctctgtataatactctgggaattcttcctgttctttgaaagtattggatgtattatttctttaactatatcatttagttatttcactaatagaggctgccttccatatctcagagttgtaaggtttatgtgtatttttaggtgatcctttaaagcactttaacagtctcacattaagagcaagctgaagctgggcatggtggcttgtgggtgttatctcagctacttgggaggccaaggaaggaggattgcttgagcccaggagtttgtggccagcctggacaacatagtgacacccctgtatccaaaa

SEQ ID NO: 1449 - DNA, 2548 bp, Homo sapiens
cgagatcgtgccactgcactctagcctggcgacagagcaagactctgtctcaaaaaaacacaaaaatcaaaacaaaaaaaaaacaaacaaaataaaaaacttcatctgatgttcttcagttattcttgtggactttatgagtgaactgggatatcacgggtaaaatcacttcaatgtttttttctttttgccacaaatcatatgggaacaatttttgtatttgttagattctcctgttatattgcacctaggaacgtattgtgtctagttgttgcatctaagactggttcaagtatcacattctggttgtgttgtcatgtagaattttaattcttccaaacatttaagaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtacgtttgcgggagcacatgggtgaaaagtatacaacttacagtgtgaaagctcgccagttgaaattttttgaagaaaacatgaatttttgagcatttgtcctaatctgctgccagaattaaagacctatttttagaggattttggcttaaaaagcaagggcaaacagtcatttggaagccactcaccactgttttatatctcttttttatatctctttggcgtttccctacagaaaagaaattggacagaacagaataatatgaagcaggatcacaaaagaaaaaaaactttggctttcatattctctttgtgaggacaaatctgttgtttgtttgattactgtttactgagccttaatccaccaagtttatatttagaattttatttttttaaggtactaattaacttaaacacagagctataaaatgctggattgaaaattttatattgtaatgtagagataaaagcagtaggagaaacaaatgacataatatgtcgtcataattcctgctattgttaataaccttaaggagtagttgataaattataaaattttaaaaagtcaattcagttctagaaatagatttaaagaatatgaagttctatctagtacttgagcagctgtatttcttttctacacattgatggacttttaatattttattctcatttaatataaacctcatctagggtatatacaaattaaaactgagacacattggctttgtaaatcagtatgtttttacataatggttttgttagatttatttttccatcagtgaaaacatttcttaaacacaaatttcatttccatttaagcaatttgtaagcaaagtccaggtccatttagtttttggatatatttaatgtttgtctcctgaagtttgtcttcatgtactgtaagatattagttgtctttccatgttttaaatgtatgattatatagcacatattttattagttgtttaataagaggtaatacccatctaggaaagaaattttatgaagttaaatacaagtcttgaatagtacattttcacttctgtattcgagggactctaaaaataaatattgctccagaaaaaaaaaaaaaaaaaaaaaaaaaaaaaaaaaaaaaaaaaaaaaaaaaaaaaaaaaaaaaaaaaaaaaaaaaaaaaaaaaagagagggcaaccagcttaaatctattaccacagagagggggcccaaagagaggacagtcaaactatgaattagaagacaagaagcgccgccatataagaagtcggctgttaacttaaaacaaaagcggagcaggccgggcatatcaagaaaaaggcgcacgtcaaacactgcggggtaagccatcaaataggtcgacaacgacaaccacacattgatttgaggtggccgacacagacaaaggtgacacactccacggagcgtatagagggataaacgaggagcaaaatagatgtagcgggaaaagtcgggtacccgcgagaagtgactcggcacgtcagtatccagtaggtgaggagtagacttgagaaacacttcacagggagggcaggcagaaagcagcagagagcagccgccagcaacgcgagcggagaacggagagtagcgcaaaagcaggtacgtcaggagacacggcgaaggcaacaagacgcagagcaacagaggcgagcggcgagcggcgtaggtcaacgagagaagacgacagcatccacgaggaaggacgcgagcactcaagatccaagtagatctagcgagcctcgtcatattatg

SEQ ID NO: 1450 - DNA, 2140 bp, Homo sapiens
atgggatttacatttacatacatatataaatgaatttgctgaattatctatgaaattgattttgttttacctattctaatattgttgggttttattgattcaaagaactctttatatacgaatgctattaatcctttggcatgaatgttgcaaatgttttccctagtttattgtttgtttgctctttaatttcttacgacttttcgaaacatcttgaagtttaaaagttttatgtaaactgaactattagtattttcctgtatggtttccaccttggataccatgcttagaaaagcccttcctctaagattacagaaatattttttcctactacatactgattgattttctttttgtttctcaaataggtacgtttgcgggagcacatgggtgaaaagtatacaacttacagtgtgaaagctcgccagttgaaattttttgaagaaaacatgaatttttgagcatttgtcctaatctgctgccagaattaaagacctatttttagaggattttggcttaaaaagcaagggcaaacagtcatttggaagccactcaccactgttttatatctcttttttatatctctttggcgtttccctacagaaaagaaattggacagaacagaataatatgaagcaggatcacaaaagaaaaaaaactttggctttcatattctctttgtgaggacaaatctgttgtttgtttgattactgtttactgagccttaatccaccaagtttatatttagaattttatttttttaaggtactaattaacttaaacacagagctataaaatgctggattgaaaattttatattgtaatgtagagataaaagcagtaggagaaacaaatgacataatatgtcgtcataattcctgctattgttaataaccttaaggagtagttgataaattataaaattttaaaaagtcaattcagttctagaaatagatttaaagaatatgaagttctatctagtacttgagcagctgtatttcttttctacacattgatggacttttaatattttattctcatttaatataaacctcatctagggtatatacaaattaaaactgagacacattggctttgtaaatcagtatgtttttacataatggttttgttagatttatttttccatcagtgaaaacatttcttaaacacaaatttcatttccatttaagcaatttgtaagcaaagtccaggtccatttagtttttggatatatttaatgtttgtctcctgaagtttgtcttcatgtactgtaagatattagttgtctttccatgttttaaatgtatgattatatagcacatattttattagttgtttaataagaggtaatacccatctaggaaagaaattttatgaagttaaatacaagtcttgaatagtacattttcacttctgtattcgagggactctaaaaataaatattgctccagaaaaaaaaaaaaaaaaaaaaaaaaaaaaaaaaaaaaaaaaaaaaaaaaaaaaaaaaaaaaaaaaaaaaaaaaaaaaaaaaaagagagggcaaccagcttaaatctattaccacagagagggggcccaaagagaggacagtcaaactatgaattagaagacaagaagcgccgccatataagaagtcggctgttaacttaaaacaaaagcggagcaggccgggcatatcaagaaaaaggcgcacgtcaaacactgcggggtaagccatcaaataggtcgacaacgacaaccacacattgatttgaggtggccgacacagacaaaggtgacacactccacggagcgtatagagggataaacgaggagcaaaatagatgtagcgggaaaagtcgggtacccgcgagaagtgactcggcacgtcagtatccagtaggtgaggagtagacttgagaaacacttcacagggagggcaggcagaaagcagcagagagcagccgccagcaacgcgagcggagaacggagagtagcgcaaaagcaggtacgtcaggagacacggcgaaggcaacaagacgcagagcaacagaggcgagcggcgagcggcgtaggtcaacgagagaagacgacagcatccacgaggaaggacgcgagcactcaagatccaagtagatctagcgagcctcgtcatattatg

SEQ ID NO: 1451 - DNA, 454 bp, Homo sapiens
agaacttccatcaaccctaaatttattatggaaaccagtttttaaaactgaggaaagttttcatgctaaaaaacaaaagccactttttatggacaacttactttggattacaatgtaccaggttgctgctatactttaaaatgtcattttattgtttttaaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctgtaagtcattttgctttggtttgggaggtggactttgggaaactcaatttctatttagagcaattaacaattgccaaaaaggcatgtaagaaatgccaggaacataataaatttagggtga

SEQ ID NO: 1452 - DNA, 1561 bp, Homo sapiens
gcggtggctgccgggactgagctcctagcacccgatcgggaagtggcgggcggagtcccgggtccagtcgccgcctcagctaccgccgctgccgccgccgccgccgccaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttt

SEQ ID NO: 1453 - DNA, 1520 bp, Homo sapiens
cttaaattacccactacgttgtccagtcgccgcctcagctaccgccgctgccgccgccgccgccgccaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttt

SEQ ID NO: 1454 - DNA, 1542 bp, Homo sapiens
gcggtggctgccgggactgagctcctagcacccgatcgggaagtggcgggcggagtcccgggtccagtcgccgcctcagctaccgccgcaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttt

SEQ ID NO: 1455 - DNA, 1769 bp, Homo sapiens
gcggtggctgccgggactgagctcctagcacccgatcgggaagtggcgggcggagtcccgggtccagtcgccgcctcagctaccgccgctgccgccgccgccgccgccaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttttaagatgttagtgaattctgtttcttttcattctcggaaatggcaggaagcagctccagtctctgatttccatgggtcacgtgctggggatgtgatgaagcctgcagtctgcactgtgttgctgagcacatggatttcaccactggaacacaggtgtgctgcttgttagcaagcagagcaataaagatgtgctggatgtcattgttaa

SEQ ID NO: 1456 - DNA, 1419 bp, Homo sapiens
gtcaggaggtttggttcctggccctggctcttccatctgtgcgaccttaaccagacagcttcacttcagatttcacgtattaaaataggaataacactaatacctgtttgctcctagagttgcgagggtcaaatactcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttt

SEQ ID NO: 1457 - DNA, 1057 bp, Homo sapiens
catcctctaaccttagatgatgcgtatctcctcgctgacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttt

SEQ ID NO: 1458 - DNA, 2210 bp, Homo sapiens
gcggtggctgccgggactgagctcctagcacccgatcgggaagtggcgggcggagtcccgggtccagtcgccgcctcagctaccgccgctgccgccgccgccgccgccaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggattttaaaaaaaaaaaaaaaaaaaaaaaaaaaaaaaaaaaaaaaaaaaaaaaaaaaaaaaaaaaaaaagagagggcgccgccgccccccaagaaactcccccccggggggcgccccaatgccgcgccccccccttttttgcacaacgggggcgccccacatataggggagcgcgctattatataaaaccagcagagcgagcaagaggggcgcgcgcgcttttataaaaacaacaccgtcgctgcccaggggagcaaaacacagcgcgcaggcacaagcgtggggcaccaccttgtgaggaaaaagagagacacctcactaaacatcgcgaggggggggggaggacacacactagggtgcggagacaacacccatcccccccagccgaagagaaaactatcttataacacgcccctctcacaggggcgcggccccaatctatcacaaccgacacccctctccaccacagagccccctgcctacatcgcagcgtgggcggacacccacaaaaacggagcgacacaattaaacgtcgccgccgccggccgcgaccgaaaaaaccctctctgacggcccctcacgcggcgggacactaccaccgccttgcggcacaaaaattatttataaacaccgcgggggcgctacaggagaaaaa

SEQ ID NO: 1459 - DNA, 1607 bp, Homo sapiens
gcggtggctgccgggactgagctcctagcacccgatcgggaagtggcgggcggagtcccgggtccagtcgccgcctcagctaccgccgctgccgccgccgccgccgccaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatgagcccattctactcaaataagctttgagtttggtaatttgcacttgttttgtaactgcactgctcctctcctcagccgcaagatgcagataggaacgacagtcatcataaccac

SEQ ID NO: 1460 - DNA, 952 bp, Homo sapiens
agataagaaggccctacttaggcttgaaagcatacttcccatctctcacgttgtacttgggcttgaaagcatacttcccatctatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttt

SEQ ID NO: 1461 - DNA, 1398 bp, Homo sapiens
gcggtggctgccgggactgagctcctagcacccgatcgggaagtggcgggcggagtcccgggtccagtcgccgcctcagctaccgccgctgccgccgccgccgccgccaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaagaatttcagaaactgtggaggagtgtcactgtagattccatggacgaggagaaaattgaagaatatctgaagcgacagggtatttcttccatgcaggaatctggaccaaagaaagtggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaatgcgaacctatgagggatcctctagatcgcctcccc

SEQ ID NO: 1462 - DNA, 981 bp, Homo sapiens
gcggtggctgccgggactgagctcctagcacccgatcgggaagtggcgggcggagtcccgggtccagtcgccgcctcagctaccgccgctgccgccgccgccgccgccaccgccagtggtgagaccccgacctggcgggtcagcgctgggcgtgcgtgcgggcaggcgggggcgctgacgagaagcaggaagagggtgcagtgccggcgtgggcggccggccgaggcggaggcgcaggaagggggcggcgagtcgtgcgaggctgcccttctcactcagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctgatcatagcaatggatcatttaacttgaaagctttgtcaggaagctctggatataagtttggtgttcttgctaagattgtgaattacatgaagacacggcatcagcgaggagatacgcatcctctaaccttagatgaaattttggatgaaacacaacatttagatattggactcaagcagaaacaatggctaatgactgaggctttagtcaacaatcccaaaattgaagtaatagatgggaagtatgctttcaagcccaagtacaacgtgagagataagaaggccctacttaggctcttagatcagcatgaccagcgaggattaggaggaattcttttagaagacatagaagaagcactgcccaattcccagaaagctgtcaaggctttgggggaccagatactatttgtaaatcgtcccgataagaagaaaatacttttcttcaatgataagagctgtcagttttctgtggatgaaggctggagtgcaatggcgtgatctcggctcaccgcaacctctgccttccggactca

SEQ ID NO: 1463 - DNA, 391 bp, Homo sapiens
acaaggatgccaacttccaccacttttatttaacatagtattagatgtcacagccagagcaaccaggcaaaagaacgaaataaaaggcatctgtgttaggctgttcttacattgctataaagaaatacctgagactaggtaatttataaacaaaagaggttcacttggctcagagttctgcagagtgtcccagcatggctccagcatctgcttctggcgaaagcctcagaacctttacaatcatggcagaatgtaaagcagaagcagacatattattggtgagagtgagagcaagaaagaaggagaagtgtcacactctttaaacaaccagatttcatgagaactcactgtctcaaggaaagcaccaagttattcatgaaagatctgcact

SEQ ID NO: 1464 - DNA, 253 bp, Homo sapiens
tgacagagacagcgccaatggcgaggatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtctta

SEQ ID NO: 1465 - DNA, 791 bp, Homo sapiens
cccgtgtattcattgggaatctcaacactcttgtggtcaagaaatctgatgtggaggcaatcttttcgaagtatggcaaaattgtgggctgctctgttcataagggctttgccttctttcagtatgttaatgagagaaatgcccgggctgctgtagcaggagaggatggcagaatgattgctggccaggttttagatattaacctggctgcagagccaaaatggcttcaattctaagagtggacagcggggatcttccaagtctggaaagttgaaaggagatgaccttcaggccattaagagggagctgacccagataaaacaaaaagtggattctttcctggaaaacctggaaaaaattgaaaaggaacagagcaaacaagcagtagagatgaacaatgataagtcagaagaggagcagagcagcagctccgtgaagaaagatgagactaatgtgaagatggagtctgaggggggtgcagatgactctgctgaggagggggacctactggatgatgatgataatgaagatggggggatgaccagctggagttgatcaaggatgatgactcttaagcacatagtggggtttagaaatcttatcccattatttctttacctaggcgcttgtctaagatcaaatttttcaccagatcctctcccctagtatcttcagcacatgctcactgttctccccatccttgtccttcccatgttcattaattcatattgccccgcgcctagtcccattttcacttcctttgacgctcctagtagttttgttaagtctta

SEQ ID NO: 1466 - DNA, 473 bp, Homo sapiens
atttagatcagtgttctgtgatgggcaaaagatccctgaaaatcctctcatgtgtgattatgtgaaatataaaggctaacaactaaaataattgcctttagatatagtaatatataactttagtcaacaaatatgcactgtgtatcttcttgtgccagatatggtactgggtaatgggtacagtatttcaaacaaatctaatattcttactatgatagagcttaaaatctgatggggttgtaaattatagtccgtacggagatagattgggcacactttggtaactgattagagatgaggggccagggagaaagggttatagaagattatgtagaagttttgctcttgagcaactgagaggatgaggttggcattaacttctttagggaatacaacaagactgtcaaatctggagaaagacacttttcagctgttgaataatttgctgaggggggtacatatggacatttgtt

SEQ ID NO: 1467 - DNA, 350 bp, Homo sapiens
ggaccagggccacccttcaatctctcaccattcatttaaccaagtagtatccctgtgcccaaactgggccagcaagtcctgccaccccattcactacctgcagggacaggagcccacttccatcaagaggactttctgaaatccaaccttggcccctgcctctggctaggccacttggttctcccctcccccagcccagaacctgtgttgagactttgggtgtggctgggaataggaggtggtagggtcagaggtggcttatttccacctctaaggaggagaattcctccacaaccagtgcagacctgaggttgggactcaggcttgcataatgaaggcttagtcacagg

SEQ ID NO: 1468 - DNA, 416 bp, Homo sapiens
aaaaaaaaaaaaaaggaaatgtattgtctggcagttctggaggctggagttcaagatcaaggtgtctgcagggctgtgctccttctgaaggttccagggaaggatgtattcccaaccttgttctaacttctggtggttccttggcagcataactccaacctccatctggtgttctgtgtgtgtgcttgtgtccaaatttcccctttttgtaaggacatcagatatactggattagggacccactctacttcagcagggccccatcttaacggattacatttacgatgaccctatatccaaatgagcagctgggtgcagtggctcatgcctgtaatcccagcactttgggaggtggaggcgggcagatcatgaggtcaggagttcaagaccagcctggccaatatggcgaaaccccg

SEQ ID NO: 1469 - DNA, 858 bp, Homo sapiens
tagcttcaattcattccctggccagtcttgtttgatctcttcccttatctactccctatcatcttggattattttgaaggaaatccaagacatcaatttattcataaatattttagtattaagattaatttttgttgttatttcctaattatcttttagctggcctgtagacttatcattttatttatattgttttttctcagcggcgggatttttcagcctgatcttttcctgagaagcacgtgataaactttccgcaggccctgacatataacatggttctttgaccacaacagaagtatattagaaatcagtagttaaaaaaaacaaaaaaacaaaaactatctggaaaattcccaaatatttggtcattgactaacacacaaaaaataaatcaaaagagaaattagaaagtattttaaactgagtaaaatgaaaacacagcatatcatttgtgaatgcagctaaagaaatagttagaagtttatggcaccaaacacctctactagaaaagaatggcttcagctcctagcctaagaaactaggaaaagaggagcaaatgaaattcagaagagtggaagaaaggagatggtaaagatcagagtggtattcagtgagacagaaatacagaaagtcagtgaaactcaaaactggttctttgaggagactgtaaaattgataaacctttaggggtagaaaaggagacgatacaaattaaaaataacagggccaggcgcggtggctcacgcctgtaatcctagcactttgggaggccgaggcaggcagatcacttgaggtcaggagtttgagaccagcctggccaacatggtgaaaccccgtcctactaaaaatacaaaa

SEQ ID NO: 1470 - DNA, 294 bp, Homo sapiens
gacaaacttattttaaaaataacatggaaaggcaaaggaactataataacccaaaccattttgtaacagaacaaagttggaagatttctactaatttcaaaacttgcagtaaagctatagtaatcaagacattatggtattgatacatggatagatgtatagatcaatggaatagattagagtccagaaatagaccatacctatatggttagttgagttttgactaatgtgtcaaggcaactcagtagagaaaggatttcatcaatggtgctgaaacaattagatatctatatg

SEQ ID NO: 1471 - DNA, 103 bp, Homo sapiens
tcaatttagaggctcagaaaataaagagtatctgagccttgggggtatcctgtggtttgctggcaaatggcaccactagtcagatcactgcagactcagatgg

SEQ ID NO: 1472 - DNA, 934 bp, Homo sapiens
tgactcaagcatggttttggggccagcatcctcagtttctatcttcctatctctctgggtgacggcccaatcttgctgggcatgcaatgtcactatttctgttctcaattccagcagcttcctttcattcaacgaatacaattcttttactctgctcttttctaggttgaagtctaatttagtatctgttcggactttaatcacttcatccattacttgttttaactgatgtagtttgagttttattttctcacgttctgctctgagggctgaaaattcactcttctccaaagtaatcatatcgtttttcacattcacagtctgagacattatttgctgaagagcgatctcctgcttcatcttggtggccatatctttgtagacgatgtccacgttggcctccagtacctggaccaatgcagacacaatgatttctgcttgctgagtagcaaacccatggtcttccagaaagcacactaaggaacgagtgtcaaaggagagcttcctactcccagaagagctgaaatctctcctgtgctccagctgcaggtatccagcagactcctgcaggaagtgcgtatgggcaccatgctgaagcatgggtgaagggcgctggcagcagcagcgatgcccagggcaaggccccacaggcacatccacgcgccgctttgtccagccagtggggcggcatacccaaggcatgagtgctcccagtccccaggctgccggcacggagcggcggcggtcaagtgcagggagggcacgaaatggtaaattttatgttgtgtatattttaccacaattaaaaaaaatcatttcttcaggtagaccagccgcatttcatgtgttcaacagctacatgcggccagtagttaccatactagacggtgtcaagtagaacactttccccactgcagaaagtggtactggacag

SEQ ID NO: 1473 - DNA, 679 bp, Homo sapiens
tgactcaagcatggttttggggccagcatcctcagtttctatcttcctatctctctgggtgacggcccaatcttgctgggcatgcaatgtcactatttctgttctcaattccagcagcttcctttcattcaacgaatacaattcttttactctgctcttttctaggttgaagtctaatttagtatctgttcggactttaatcacttcatccattacttgttttaactgatgtagtttgagttttattttctcacgttctgctctgagggctgaaaattcactcttctccaaagtaatcatatcgtttttcacattcacagtctgagacattatttgctgaagagcgatctcctgcttcatcttggtggccatatctttgtagacgatgtccacgttggcctccagtacctggaccaatgcagacacaatgatttctgcttgctgagtagcaaacccatggtttgaggtcaggagttcgagactagcttgaccaacgtggtgaaaccccgtctctactaaaaatacaaaaattagctgggcgtggtggcgtgcacctgtaggcccagctacttgggagactgagacaggagaatcacttgaacccaggaggtggaggttgcactgagccaagatcgcgccacggcactctagcctgggtgacagagcaagactcaaaaaa

SEQ ID NO: 1474 - DNA, 454 bp, Homo sapiens
gttcccagccacacccgccaacagaggaggaaggtgctggtactgatgtccccacccgagagtctgtcctggccttggttttccacagtgagggctcgttctaatgttgcacaatgtcatactcagatatcactgtgacctgttactatgctttagaacccgagaggcctctgttcacatggcagcatgtgtgagtggatgctcccggagcaggtggagtggtggcgctggatagcggtaagagcgggggctccaaaggcagaacttccagcttcacatctcagctctgcacctgctcgctgtatgactttagcaagcaactggatctttctaagcgtcagcttcgttgtcttaaatggtagttggtaataatagtccatgcttcgtagcatcacttttgtgttcaagcagaatgctgagcacactggcaaataataagagctcgtaaatatta

SEQ ID NO: 1475 - DNA, 1522 bp, Homo sapiens
agagaagtgagaccctgcagctgagggagcatcatggcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaacaaagagaaaacgatggagttctggaaagggtacccaaatgcagtctactctgtccgagacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccggtacctagccagtcgcgccgggcacaccctcccccgggtcatggtgtaccggggtactgtgcatagccaaggggagccttctgggcaccgagaggcagcgagcagcccccaggtggtgctggggcccagtcgggggggcaggaccacagtccggctagagagcaccctctacctccctgagctctctctctccagactgtccagcaccacccctcccccctcctacgaggaggtgactgcgccccaagagagcagcagtgaggaggccagcgtgtcttacagtgacccacccccaaagtacgaggagatagtggccgccaaccctggcgctgacaagtagtgggacgtttgtgccctgtcctggatgaacgcctctttccgaggtctcctattttctttttaactttttaaagactgtgccaccacaaaacagccttagcctccttgttgccaaataattccctaactgtggagttttaggaagtcagttgtcagagacaggtggggagggtgggggtagggaccacgcatgagtcgaagcccccgggaagagccaaaggccaaagtgcccaactctttgggatgacccccaagcctccaacatcctgtctttccatcaggaactggcttctcttatgccaaaggaataaccccattgagttgattgtggccagaatgtccacaggcctggcctgggggctgtgggactggctggaggcctgcctgtgtctagagctctgggcctcaggggtaagggaaggaagccagcctttcagcaccccttaccctccacagttctgtgatttctgtccttgcttacatttggaggacagggacaaggactgagcaaaaacaaaatgaaaaaatcatgacaaataaataattaacacaatagaacaaaactctagcacccgggccgttcataggaggccaagggaaatttatcacatggatctgtgatgtccgcctcccctaaaacctgtccccacactcctggaaggaggacagggtgtgtgaaggatgagggccagagggctgggtggcagagtttcctcttccacattgaccaaggggcccacgtggactctgccattcagtttctagtgtgcttgtctctccagacatgtggacca

SEQ ID NO: 1476 - DNA, 1825 bp, Homo sapiens
atcgaaatcctgtccctcccccgcttcccatcgcctccggttttcaaaatgaaagcacaagtgcaagagtggggtgcacaggtgcctggcgtgtacacaccacccacacagctgcgtccagccctggctgagggagacgcagtgctgagcagtcagccccgggaggcctctttttcaacttccaatcccactgccatgaatgtgaattccttagggtgcttccaaaaacaggagtctgcctgatctgttggacattgcctttttggtagcccgaatatgaggaattcaggacaggaaagtgtctttttgtcaagtagtcagagccggatgcttcccctctcccagtgggtggagcatcgcaacccccagccagagttgatcttttgacaacccagtgacatcccatgagaaggaagaaaaaaaattcaacactgcctctagattgttattttgtccaagagagagatcatggagagagtctctctcgctcacggaggctctgtctttctaggagtatgtgtgtgtgctgtctcatgtgtggacactcacagttgaggctgagatggatatcttggcagcagagctgctggtctaggtggcttttcagcttgacaagtaatgaagctccatttcaggacttcatcgattccgaaacaagcacagccccccaccccccgccacggaactctactaatactaatcactataattagctaatttaaaagtacggtaatcagactgcttgcaactattttaaaagcccattaatttgaagcccactacttcagaacttcgagaaaatcacaacttaagacaattcacagtagctgtgattctggctacataaaaatatttgaaatattcttccctttagtcaatgttcagggtcttttgtgtaagagaaatccagtttaaaatgagtacccttttcaaagaaaaggctcaagatattaaggatcccttcaccgtgccttcagctttgcagttcagcacttctcgtatgtacagggtgatctcttgttctctctccatcacagggatgttggatattgcagcctttcactctactccgttatttatcctgtggaataacatagtttgtgaactagactgcaatttaaactaatacacatgatgtatctttctaaatattctgtaaagcagatgcttcgctgtcagactggccgctccatcattcgcctccaaatattcaaacgtgggagcttttcctttcagactgtgggcagcgagtctctctctagcaagaatttatctgacaaacatacccaaatagcacaccctctcaagctcaatgcctcaacagttgtttcactgtactgatatctgactgctgaacagtgcctgcccttcacccacccccagcccgagcattaacacagatcttcaggattgggacaaatcccccagctgcttttgcctctcaatccatctcccctcatcgataccaatttcccaggcctgaacacatctgttattttgctctgacattgtgaatttgtgacagtggaaaccctgatatgtgcaactgagcttatagaaataattactgtgaaatggattaattttgataccactttaaactgtgcttgtattcatgtgttgacccttgtcagctgggaaatctgtacattcagtatatgtcagcatttcattggagcctgggggcaacagacaaacttgcttctgatttctctctctctctctttctttttataattgttgaatttggctgttacattttgtctccttctttacaagaaaacaataataataaagagcaaatggcatccacttgaaaaaagtc

SEQ ID NO: 1477 - DNA, 1053 bp, Homo sapiens
agagaagtgagaccctgcagctgagggagcatcatggcagtgtttctggaggccaaggatgcccattcggtcctgaaacgattccctcgtgccaatgagttcctggaggagctgcgccagggcaccatcgagcgagagtgcatggaggagatctgcagctacgaggaggtcaaggaagtgtttgagaacaaagagaaaacgatggagttctggaaagggtacccaaatgcagtctactctgtccgagacccctcgcagagctcagatgccatgtatgtggtggtaccccttctgggggtggcactgctgattgtcatcgccttgttcatcatctggaggtgccagctgcagaaagcgacccgtcaccacccctcctatgctcagaaccgcagatgcttcgctgtcagactggccgctccatcattcgcctccaaatattcaaacgtgggagcttttcctttcagactgtgggcagcgagtctctctctagcaagaatttatctgacaaacatacccaaatagcacaccctctcaagctcaatgcctcaacagttgtttcactgtactgatatctgactgctgaacagtgcctgcccttcacccacccccagcccgagcattaacacagatcttcaggattgggacaaatcccccagctgcttttgcctctcaatccatctcccctcatcgataccaatttcccaggcctgaacacatctgttattttgctctgacattgtgaatttgtgacagtggaaaccctgatatgtgcaactgagcttatagaaataattactgtgaaatggattaattttgataccactttaaactgtgcttgtattcatgtgttgacccttgtcagctgggaaatctgtacattcagtatatgtcagcatttcattggagcctgggggcaacagacaaacttgcttctgatttctctctctctctctttctttttataattgttgaatttggctgttacattttgtctccttctttacaagaaaacaataataataaagagcaaatggcatccacttgaaaaaagtc

SEQ ID NO: 1478 - DNA, 1007 bp, Homo sapiens
gagtcgcccttgctcccccagcctcagccctcgggaggcgcagcgtcagggcgggcggcagcacagaaaccccccgcgccgctagagggaccctcgcagcagctgcgcgggcgacctcgcggtcacgtgcggcaagggcgggaccaaacgagcgtccggccaatcgactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggccctggagctggactccatccgcagccaccactggtgcatccagggctgcagcgccgtcaccggggagaacctgctgccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccga

SEQ ID NO: 1479 - DNA, 1207 bp, Homo sapiens
gagtcgcccttgctcccccagcctcagccctcgggaggcgcagcgtcagggcgggcggcagcacagaaaccccccgcgccgctagagggaccctcgcagcagctgcgcgggcgacctcgcggtcacgtgcggcaagggcgggaccaaacgagcgtccggccaatcgactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggccctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccgaaaaaaaaacaaacaacataaaaggcggcaacaaaaaaccacaagagggcaccaaaaagaaccc

SEQ ID NO: 1480 - DNA, 1144 bp, Homo sapiens
gagtcgcccttgctcccccagcctcagccctcgggaggcgcagcgtcagggcgggcggcagcacagaaaccccccgcgccgctagagggaccctcgcagcagctgcgcgggcgacctcgcggtcacgtgcggcaagggcgggaccaaacgagcgtccggccaatcgactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggccctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccga

SEQ ID NO: 1481 - DNA, 1037 bp, Homo sapiens
gagtcgcccttgctcccccagcctcagccctcgggaggcgcagcgtcagggcgggcggcagcacagaaaccccccgcgccgctagagggaccctcgcagcagctgcgcgggcgacctcgcggtcacgtgcggcaagggcgggaccaaacgagcgtccggccaatcgactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggccctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccactctcacccagctgtgtgtattgtgccgtgtgtctgggccccgtcctgcgggggttgccgggctctctgccgcggttgtcctccaaaggggggaggcggggacgggggcccac

SEQ ID NO: 1482 - DNA, 1067 bp, Homo sapiens
gagtcgcccttgctcccccagcctcagccctcgggaggcgcagcgtcagggcgggcggcagcacagaaaccccccgcgccgctagagggaccctcgcagcagctgcgcgggcgacctcgcggtcacgtgcggcaagggcgggaccaaacgagcgtccggccaatcgactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggccctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccagcccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccga

SEQ ID NO: 1483 - DNA, 503 bp, Homo sapiens
  misc_feature (42)..(42): n is a, c, g, or t
  misc_feature (52)..(52): n is a, c, g, or t
  misc_feature (71)..(71): n is a, c, g, or t
tttttctttttaaacgcaattccgggggaggttcttgggagntgggaattcnattcggcaagccaacccanttggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccga

SEQ ID NO: 1484 - DNA, 1106 bp, Homo sapiens
gagtcgcccttgctcccccagcctcagccctcgggaggcgcagcgtcagggcgggcggcagcacagaaaccccccgcgccgctagagggaccctcgcagcagctgcgcgggcgacctcgcggtcacgtgcggcaagggcgggaccaaacgagcgtccggccaatcgactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggaggtgggcagctcctaccctttgtgtacatgtatggacgtgtggctgccttctcagcagatgcccagaggggcccgtggccccagagggaaaccagaggcaggatcccttccttctctgggcccccaccatgggaggcccatggtgccagaggcaggacacatgctgtggactgagattgagttaacgtccctgtggtgttactacgtcactaccctgagcatcagtttctatgccttgaaatggtgatgatgacacccacatcactgggctttagggaggataacccaaggccagtatgaagcttcgagaggccatggagcctggctcaagagtctgactctttgctgtgtgacctcagctgggggtggtggcacgcacctatagtcctagctactctggaggctcagacaggaggatcagttgagcccaggaggttgaggctgcagtgagctgtgatcgtgccactgcactccagcctcctgggcgacagagcaagaccctgtctca

SEQ ID NO: 1485 - DNA, 1575 bp, Homo sapiens
gagtcgcccttgctcccccagcctcagccctcgggaggcgcagcgtcagggcgggcggcagcacagaaaccccccgcgccgctagagggaccctcgcagcagctgcgcgggcgacctcgcggtcacgtgcggcaagggcgggaccaaacgagcgtccggccaatcgactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggccctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccgaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaagaaaaaaaaaaaaaaacaaaagaggaggcgcggaacataacaaacaaccaacaccacgcgaccacgacaaacaaaaacaccaccacaaccaggcaacaacaaaaagaaacaaagagcgagccaccacaatgaggaggacaagcaaacaaaacagcacgaacgcgccagcacacaataatcagcaaaacacaaccacgcgaaaagaacaaaacaccagcgccaagacgactacaacaaaaaaacacaccaagaagggggaaccaaaaggaaacacctaaccaaaaaacaaccggcacaacagaaaaaaaagacaagatcagcaggaaa

SEQ ID NO: 1486 - DNA, 1052 bp, Homo sapiens
cagacacatacatttaggtgacactattgaactcgaaggaatccacaagtttgtacaacaaaagcaggccttgtaaaccgaccgcccagttaacctataacgggtcctaaggtaccgaaggcctggtcgcggaattcggcacgagggcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggccctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccgaaaaaaaaacaaacaacataaaaggcggcaacaaaaaaccacaagagggcaccaaaaagaaccc

SEQ ID NO: 1487 - DNA, 1063 bp, Homo sapiens
gagtcgcccttgctcccccagcctcagccctcgggaggcgcagcgtcagggcgggcggcagcacagaaaccccccgcgccgctagagggaccctcgcagcagctgcgcgggcgacctcgcggtcacgtgcggcaagggcgggaccaaacgagcgtccggccaatcgactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggaggccctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccga

SEQ ID NO: 1488 - DNA, 600 bp, Homo sapiens
  misc_feature (22)..(22): n is a, c, g, or t
agggtagcagctccgtcccggncccagccctttcttgttggtatggtagccaaagcgcctggccggagcaaccctcctcatctttgctaataagcaggacctgcctggagcactgtcctctaacgccatccgcgaggccctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccga

SEQ ID NO: 1489 - DNA, 1114 bp, Homo sapiens
gagtcgcccttgctcccccagcctcagccctcgggaggcgcagcgtcagggcgggcggcagcacagaaaccccccgcgccgctagagggaccctcgcagcagctgcgcgggcgacctcgcggtcacgtgcggcaagggcgggaccaaacgagcgtccggccaatcgactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgcttggcctggacaatgctggaaagacaaccatcctgaagaagttcaatggggaggacatcgacaccatctccccaacgctgggcttcaacatcaagaccctggagcaccgaggattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggagcgcctggccggagcaaccctcctcatctttgctaataagcaggacctgcctggagcactgtcctctaacgccatccgcgaggccctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagcccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccga

SEQ ID NO: 1490 - DNA, 573 bp, Homo sapiens
tctaaacagggtagcagctctccccgcccgcctggccggagcaaccctcctcatctttgctaataagcaggacctgcctggagcactgtcctctaacgccatccgcgaggccctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccga

SEQ ID NO: 1491 - DNA, 721 bp, Homo sapiens
cggaggcgtcgaatggcctcagtggaaaatatgggtggggaggacacacaggaaaacgacggtaagaacacagcagccgggcagggctccatgctaacactccgcagatggcctcagaacgcctccgggaggcgttgaatggccggaggcgttgaatggccggaggcgttgaatggcgcctggccggagcaaccctcctcatctttgctaataagcaggacctgcctggagcactgtcctctaacgccatccgcgaggccctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccga

SEQ ID NO: 1492 - DNA, 355 bp, Homo sapiens
gtacctagaccaggtggcagcagcagtggctggcgtgggtggagagatgcagccaggtctgagagacgctagagggagctgctagagggcagggcacggatatgcccactggggtcggagttgccatagccaagggctgatggctccatagaccccacagagctatcagtgctggcaagacatggagccaagctgtctatagggcagccaagagtctgggcaagggaagtgggttccagcacatagggaggaaagcgggtgatcccgcagagggaagagcacacagccacgcccaaggcatctccacccccacaaaaggccccactgcaagttatctgtcaaaacctccaccaca

SEQ ID NO: 1493 - DNA, 214 bp, Homo sapiens
gctttctgaattggggcaggtagaagcaaaactgttccattcttgtgacttctgggtcccccagaacaatcactgagggcttctgtcactggctcgatggctaaaggaagagtaacataagtgttgttccctctggttaaataagcaggctatcataggtatagaattaaagcccataggtttaggcggggagcagtggctcatgcctgtaatc

SEQ ID NO: 1494 - DNA, 977 bp, Homo sapiens
gaagcttgactttgtattattgtttatatcatagcatcacttacaaaacaagcacatatataaaaagttgtcaagatgttgctgaaattgttgaagttcctctgtgggcttggattctaacaggtttccagtaagagttcaccttcctcttgtttgatttcagcaaatcacataaaaacagacacttcctgtcttagtaccaacaaaggaaggcacaccctcactaaaagtagagcagaggtgagagattcagatttacttgcctttgtaggacttcttggagaagtttattgtttcattacatgtcagcatataacgagtcaagctgcttgcattaacatcaatgcaatgatatgtatttctccaacaatggagaaatacagaaaatctatgaagtggaatgttcagtattagaaaaatcccatagaatcattggtgaattaaaaacagatttgagacagtttaatgttcctcatactgtaacaaagaaaactttatgaaatgtttaagtcataaaactgcaatattagttctgccaaagtaaaaaatatacaatgatgatggcaaggagaaaatcattggacattaatgtgcctatgtgatcttaaaaacaaatggaatggaatgtgagattgcaattcttactggattcaatgaaattactaaaatgcattgatagtatagcactttggtgttaaatgtaaaaattaatgtctaaatatgatacctcaaaataataggtattagactgctataagaattatatttgttttcatgtatgagtctctttcaaactgaaggttctggtatcttaagaaagtatgcgtattttgtttccataccgtatttataaagctataagttaatgaccaatatttctaagtaggatttcatgtaagatgcacacttctattacaagtgaaacctacgccaaatgttaaagacaaatagcataagaataaagatgttttcttgta

SEQ ID NO: 1495 - DNA, 406 bp, Homo sapiens
gctaagaagggggatgggggaagtctatgtgggaagagatctggctcttggcagcattcatgcagtcctctcacaaatattctttccgaagctgtttctgttcctggctgtatatttgagtgctgagttagttcacccagtcgatgtgtgcacactcatctggtggctcaagaatcatgggaaattttcatgttcaagagaattttacagtctggatgcttgatgtgtaccagggcacggtttggagcctgaaacatggtggtagtgagtgccttggacttgtgctcttgccaaacggtggagtctaagccacccttagggcgttccaacccagagctgtcctgataaattttactggcccgagacaagtactccctatgagtacttgtcacagggagtacttgtg

SEQ ID NO: 1496 - DNA, 407 bp, Homo sapiens
gagttcaacatgaatgagcgctgtttcagaacactctcctttggtagcctagatttgtcccaaattattctatcaatggccatctaaccaaggaagtaaggaaaatgtgttagggatcctaggggaccacaagctcagtgaaatagcagcctccttgtatcatgaaggggatgagcactgcagcccattacattctggcccaagccactgtgggggtgctgcgaggaattctggagctcactagtttctaaaatccacatcaggagaatctggaaaagtcccaagaaaagtaaaaagcaaaaaaaggaaaaaagaaagaaagagtgaaagagagatggagggaaggaaggaaggaaagaaagaaggaagaaagaaagcaaggaaggaaggaaagaaagaaagagaaa

SEQ ID NO: 1497 - DNA, 518 bp, Homo sapiens
atacgcatggcttcttttttaaaaacgttcagtcttactagaggtttctcaataattttttcgaagcaacagctcccggcttcattcatattccatttttgttttcaatttcattgatgtctgctttttgtcttcctttgttctgctagttgtgggttcattttacttatcgttttctgttactgtggatgctcagattattgatctgaaaccttcctttcataataaaagcactcaatgcaataaatttccctctaagcactgcattatctgtgcccacgtattttaatatgctataatttcacttttcttccctttaaaatatgttctgatttctcttgagaattcctctttggtgatttatttatgactatgttgtttaacttccaggcaatttcagattctcctgttatccttctattactgaattttagttcaattccattatggtcagaaacatactttgtatgatttcagttattttacattcattaaagtttattttataaaccaggata

SEQ ID NO: 1498 - DNA, 804 bp, Homo sapiens
atgcattttaatttttaaataaaaactagggtttggattgcatggaggtttggtaagtgtctattcaatcagaatagaaagcaacattcactaaattatttccatgccaggtttcactttggggcctgtattccttaggtctcagcccatgcagcacctcattcctgcggttgtccctctgcccttcccttgcccctgttatagctgtcatcatagcacccaccttgctgtccagaagctgagggtggacttgtccatctctcacactagataatgagcctcatgagggcaggaactgtgcctgtgaacagaggttcagcacagagccctagagggtccagtggctgacatggaatagtgcacagcagatgtttgttgaaaaaaaaaaaaaaaggatacatcagctaaataaaagcaaagttaacactttttatgaataaaccagccttagaagaaaccaaacttgtagctagaaaggcatggaggcaaacttggtcttaaattcagcacattcattttgcttcatgtcttttgcttcttggaaaattgtcccaacgccagcaaaactagatttttttcctcttcttttggccctaaattatttctgaaagttacagcatttttagatttgtattgttttattacctgtcatttttattcacgtccgcttttgttgctctctctctctctcactggacctcttcctagtttaacttgactattcctctgttaagctgttcctcatatggaaagttgcctcttcatcagcacaccataaataatccaacctggtcgacagtcttt

SEQ ID NO: 1499 - DNA, 209 bp, Homo sapiens
aggtttgtttgaaattatctgcaaatttcaggtctgtgtttttgattagactatctcagaggtggaacgccactgactcaacagagaaatagccagctcctcctagtggaacttttcttaaaacctcattggttttaggaggaaaaataccatttgtttctttcataagcacttaatgggaacaagaatcttttattgtgactttcaaa

SEQ ID NO: 1500 - DNA, 286 bp, Homo sapiens
gcctgagcgacagagtgagactctgtctcttaaaaaaaaaaaagaaaatctgggacctcctccctctttctcaggtagctgaggcatgagaaccacctctaggaggcagaggttgcagtgagccaaaaaggtgccactgcactccggcctggcaacacagcaagattccgtctcaacaacaacaaaaaagttccgttttaggccagatgcggtggctcacgcctgtaatcccagcaatttgggaggccaaggcaggtcaatcacgaggttaggagattgagaccat

SEQ ID NO: 1501 - DNA, 669 bp, Homo sapiens
ccgggctgcaggaattcggcacgagacaccacaggggacctgggaatctactgaggatacagatttcccacaatccgagactgtgtgtctgcctgattgttacataattttaattgggtgccacacaccgagagaggttgtttactggtgggccattcggtttccagtaaaagcccttccactcactgtggcatggtaaatggagctcatcacatggtcccttcagcctttccttgaatcatttccaccccttccctaattaccctctgtgatccctttcccggcaagggtccttctagccttgctaccttggtaaacctgtggccttaggatcgaggtgtggacattaacttttctgctctggcggcttcctgggctgtcctctccatgttcccagcactcaggggcactgtcctttcctggcagcctagtaaatcccaggcctctgttttgggccctttggcttcttggtgcctgttatgctgaagcgtagaagtgtcttagtcagagccccaaaggacactcaccggcccacgttctcatggagctgggtagctctgaccagacttgccctctggggccctgtcctttgaccacgctgtctctatcccttctgaggctaaggcttcctcacactgcaagatccagccgaggcaggccttggcgctg

SEQ ID NO: 1502 - DNA, 628 bp, Homo sapiens
gcgggtccaatcggctgggagcctcgtggaggctgaggtgagtcctggaggtgcgtggttggggcggagagcattatctgcggctccgattttgcagattctggctgaggcgttcgtgatgtcagcagcagccgagacgggcgtgttaaaggccggttgctagggctgggggaactcaggtaactacgggcgtccccacagcagtacttggaagcccctcagctactcggcgcggttgcgggtgctgagcagagctgcctgaccgtgcgtgtgcacgggctggcctgaggatgatatgaccgtgtgttcggtgtgtggaaccctccgtcaccctcccctgaccgaagactcgtttaggaatgtgtggcaggtctgttgccacggtccaggccttcagtgcatcttggaaacatcgttttgggggctgtaggttaggaagcggagatcatggggtctcggaagaaggtttggtcgtgaactgtcagaaaggaggcgaaagctgtgcacgtggaacaaagtgaacagtgcaagttgtatgggaggtagtttaaatatcgaggcgatgaaaaaaggctgctagaattgggcttactcgaaaggaagtgggcctcagaagataatattagtt

SEQ ID NO: 1503 - DNA, 281 bp, Homo sapiens
tttttttacctgaatgcttgcagttaatttgcgtaaattatatctgcatatgatgctactccactggatttcctttaaaaaacaagcttttggaatccaacagcctcaaggaatagcataggttaaaaaatacatcctcattcatgtaattttatcattgtttaaaatgctttgttaaagtgtcagcagcatattttgatggatattttcaaaaagtctttcataaaatgttctttgattcctactcttatgtatctgggccaaatatgtcacaagtatga

SEQ ID NO: 1504 - DNA, 327 bp, Homo sapiens
ccatatcacacctatggtatgataggcactgtgtgaggttaggatataatgatttatggagaaatgaagtaaatgatcgattccttcttaaggcattaaccagaagtcccttcaaaccccaaagtaactgaactagcatactaatggcattgattgtgtttgggggccttgaactttgacaatactgatggagaatagtttccttcccctttctggaatttaaaagactagcctaaatacacttatgtgtgtatatgtattatatgtatatgtatatgtgtgtgtatatgtccatataattaaataaaatctttaaatagacaaact

SEQ ID NO: 1505 - DNA, 391 bp, Homo sapiens
tggaaaaccagcttcttcttctgctccccctacctgcccattggaaagggaaaggaggaaagggagctttgtgagtaaaaagaagataacatctacctacattaagcattctcttgtgtggatgtgatctatgacttcctcgggttaggttaatctatttttgccattttatcttccttcactgcatttctcttgatgtaggtcttttgctcttgctgatatttcaatgattgactgaggatagaagaaaggagccaaaggcagtatgtgtgcccactctattatgttgaactagtaatttaaaaaaaacgagtatgtctgggaggctaaggcaggtggatctcttgaggtcaggaatttgagaccagcctagccaacatggtgacacccc

SEQ ID NO: 1506 - DNA, 841 bp, Homo sapiens
tttttttttttgagacagggtctcgctctgtcgcctagggtggagtgcagtggcgtgatctcagctcactgcaacttcctcctcctgggttcaagcgattctcctgtctcagcctctcaagtagctgggattacaggcgtgtgccaccatgcctggctaagtttttgtatttttagtagagactgggtttcaccatggtcaggctggtctcgaactcctgacctcaagtgatctgccagcctcagcctcccaaagtgctgggagtactggcatgagaaccaccacgcctggccagaaaatagttaaagtaaaggaaccactggtggatgctaaaattatggaaagtgtaagtggaaaaaggatatttacagtctcgaattaacagacaaagtggcctggtgtgatggctcatgcccgtaatcccagcactttgggaggctgaggtgggaggatcccttgaggccaggagtttgagaccagccagtgcaacacagtgagaccatctccacataaatattaaaaaattggcctggtgtggtgatgcatgcctgtattcctagctacttgggaggctgaagtgagaggatcacctgagcccaggagtgtgaggttacagtaagctatgattccaccactgcactctagcctgtgtttaagagcaagaccctgtctctaaaaaaaacaaaaaatcaggccaggtgtgatggctcatgcctgtaatctcagcactttgggaagctgagttgggaggactgcctgagtccatgaggttgaggctgcagtgagccatgattacacaactgccctccagcctaaacaacagggagaccctttctcaaaa

SEQ ID NO: 1507 - DNA, 1737 bp, Homo sapiens
cctattactactgaagaggtacttttaaaaatgctattttaagtcaggtgctctgtttttatttaaaatagtttaagtctagagagcttattaaaaataaacaactgctagttctatctttagtattatctatgcaacatagttcaggaagtttttacatggtctactatgttttacttttacttcatattcttgctaattaatgcttccagaggaaatccttcttaactactaaagaattaatgagcatgcaaaaatgtcccctctataacgccaactatcaaaaacttctgtcagacctgaaactgaagcttcattagctcccagtaaatggacctctgtacggctgatctgacacaagatgatatgcattgacaagctctttctctatttactgaaggaattgcctgcaataactgaatagacacaaatgaccacttgctatggtctgaatatttgtgtcccccaaaatttcctatgttgaaacccaatccctagtatgatggtactaaaaggttagacttttgagaaataactaggtctcatacataggagagtggcacaaggctctgccctcatgaatgggattggtgccctgataagagacctggctagtcccttccaccatgtgaggacactgtgagaagggcagagagcagccctcgccaggcaccaatctgctgggtgccttgaccttggacttctgggcccccaggactatgagcatacatttatgttatttctaagcctcccagtttatagtattttgttacagctctccaaatggactatgacaccaggcaagtcaaaactgagatgtgtagattttattatatactaaaacaaaaaggattttagtggaaatggattcatgaaatatattaaaattggaggcaaagtctcaggtccaacactgagtcatcccatacagtcacaacaactgataaaatctgaaagtaactctgacatagttaactggtactagacatataatcacagggagtcattaaagggtaccatgaggatcaaacaacttttaaaagtagcaccctctgagaaggcagaacataatctctttctttaactcatgctagttgagaaatcatttcggaactgatgcctgaactgaaatcttgtgaagtaggagttaggaagtacaatgcaaacaacaaaaggcaaagggtaacccatcacacacttagacaactatgcattatgtcattatcccgtaggcaagggcgagtcataaaggcaaaaataaacacacacacatacaccaagatcaaagtcaaaagccaacggggagaaagtatgtccaagaaacatcaccaaggactaatataatacccctaccatacaaaatatcaccaaggactaatataatacccctactatacaaaatatcaccaaggactaacataatacccctaccatacaaaatatcgccaaggactaatataatacccctaccatacaaagtatcgccaaggactaatataatacccctaccatacaaagtatcgccaaggactaatataatacccctaccatacaaagtatcgccaaggactaatataatacccctaccatacaaagtatcgccaaggactaatataatacccctaccatacaaagtatcgccaaggactaatataatacccctaccatacaaagtatcgccaaggactaatataatacccctaccatacaaaatatcgccaaggactaatataattc

SEQ ID NO: 1508 - DNA, 528 bp, Homo sapiens
acagggcagtccgagaagagggtctgtgtgtggggtgggaagaacagtgcctctgttttctccctggctctactgtcaatgacacgtggggccttgagcaggcctcctttcctgcccttagcttacccattttgtttgtgaggtggatgccatggttttctgttcctctgctgggtaagaatacctactcagctttgtctttgcagttcaggagtggagaacctatccaggttcagagagcatctttaggctgagtgtggtggcttacacctgtaatcccaatgctttgggaggccaaggtggaagaattgcttgagcctaggaatttgagaccagcctgggcaacataaggagacacttgtcccaccgccccatctctacaaaaaatcaaaaagttaggcaggtggggtgatgtgcatctgtagtcctagctactcaggaggctgagtggggaggattgcttgaacctgggaggttgaggctacagtgagctgtgatcatgtgactgtactctggcctgggcaagac

SEQ ID NO: 1509 - DNA, 607 bp, Homo sapiens
ccaatggttttgttccagacttgagacccgggagaacggatggtttagttcaagtacagaaccaggaaaatacaaatgtcctagttagaaaacagtcaggcgggataaacttcctcttacttaaggggaggctggcctttgtgttctatttaggcctccaactgattggatcaggcccacccacactggggagaggggtctgctatgtagagtctacctattcaaatgcggattcttcctgtaacactcaacagagtggtacttgaccaaatatctggacagtgtgggccagtcaagttgacatgaaaaattcaccatcatatctgtctattggtagatgaagtcttcattcctaaatattctactttctcattactctgtggattaggactcatatttagaagaattaacttgcctccctaaattttaaaggaaggtgtccactctgtaaccagctgtgttatttctaatgttatagtgtgcccctgagagtagtaactatttctttttcttggtatttaagtatgatgttggtctgctagaccatttgtccctaaggcttgtagatcatttgacttgttcagatttaaattttatttaaattttg

SEQ ID NO: 1510 - DNA, 427 bp, Homo sapiens
accattagatctcccattctcctcaactctagctctttctctctctcccccaactctaactctctctcacccccattcccttgcctactcaagggacttgcgtgctgttctaggccttgtcttctgagtgaagcttctgtgatctagacacatttttctacttttctttgtcctaaatacagtaatgcaattgtctaccctgttaatgccaagactgggtttagacctgaccaacctaacacctgaaatgtcactaagtgatacttcctaccacagacttcatatttttctctgaaattgaagtaactactatttttcattttgaaataattatttttaattgttaacactttttaaaagataaaacttatttcttaagtatattacaggcatttaaacattccagtgtttttcatcctagattcaa

SEQ ID NO: 1511 - DNA, 380 bp, Homo sapiens
ttttttgagatggagtcctgcctgggtgggagtgcaatggcacgatctcggcttactgcaacctctgcctcctgggtcacgcgattctcctgcctcagcctctgagtagctgggattacagggtgcccaccaccatgcctggctaattgtgtgtatttttagtagagatgggggtttcactatgttggccagactggtctcgacctcctgacctcgtgatctgcctgccttggcttcccaaagtgctgggattacaggcatgagccaccacccccagcattcatgtttaaatgtagatgttttggatattctgggatctccctcacttattttataatccagaaacatctggagcttcaactagacatcagatgtatgac

SEQ ID NO: 1512 - DNA, 491 bp, Homo sapiens
ggccctccacagaaaatgtttgctcatctctatgctacactctagaaagatgcagaaatgtatcttgatctaggtggtggttacatagataaacacattggtaaaaattcatcaagcatttaattcattttattgtatgtaagccataactcaatacttctttttttaatgaaatgaagagtaacagcccctgccttctggcaatttaaaatctggtaggaggatatcaaagtaaataattaaaatacaatagtgagcctgcacagtggctcacacctgtaatcctagcactttgggtggctgaggtgagaagatcgcctgaagtcaggagtttgagaccagcctggccaacatgttgaaaccctgtctccactaaaaattagccggatatggtggcatgtgcctgtagtagtcccagttactgaggaggctgaggcaggagaatcacttgaacccaggaggcagaggttgcagtgagccgagatcgtgcc

SEQ ID NO: 1513 - DNA, 1408 bp, Homo sapiens
attttcttgcagggagagtgtaaataatctggaagaaatactgcagtctatcacagatcccaaagatagtttcatcatttgtatttttacaaatacttactggatactattcctttctgtgaggcaagaacaaccagctgtcattctctaaaaattttcagatattaagcacatattcacctctgaactttaatgttttttctacatcagcattattcagaatctcatccaggaactatttgctaacaatctgcaatgagataagaagattatgccaggaagtaaatcaacacactgcttccttcaccacgaaagccttgctacaaaaaatcaaatggcagcagtactgaacagtgcacttactgatgtagttggttaacattttggcttaagctccttatcttgtcatggacaggtaccgaatactctggactgacagaggtcgacaaactatgctctgagtggcactgttctgcagcaaagtggttttacccataagaccattcaattatagaattttagaactgaaagatgtcttagacaccatctagtccaagttcctggtttcacagccgaggatccttagaacctgaaagttttagcaaacttcccaaagccacttagtggttgtgatgcaatatgaagtaaaggccaactgtcctgactctttccaatcaccaccatgccctgaaattcctgaaggaagcagaatttcctctgaggtttctgctgagtcatatgcaggctccatctgatgtagagattcagtagaaggggccaggttgcctcctgatgggggcagcgtgtggaggatgagcctgggcttacttggcagacagatctggtcatgttccagctctatctcctacttgcagaatgtcttcgggaaaattacctacattctcaaagcctcagattcttgctttgtcaacattccttgaagattgctaaactgaagactctggtgttcccttttgtgatagggagaataatagccccccaaagatatctacatcctaatccttggaacctgtgactatgttatgtcacatggcaatgggagacttgaggttccagactgaattaaggttgataatcagctgaccttgagatggtgagactatctgggatcatctgggtgggtccaatgtcatcacaatgttccttataagagagaggcaggagagaaagaatcagaaaggcggcagcatgaggaaggctcagcctgacattgctggcttagaagatggaggagtgaggccatgagcgaaggaatgcaggaagcctctagaagctggaacacacccctgctgacacctggacttgtacctagtgaaacccatttcagacttcagacctccaaaactgtgcagtaataaagctgttttgttttaagccactgatttgt

SEQ ID NO: 1514 - DNA, 325 bp, Homo sapiens
gacacagggcagctcctcacccagcacagagccaaggccttagtggaatgttcacagaaaccacagagggacttggaattgtgcttctctcctgaccacaagggctccacagctgaccttcaattctggtggatcattaaatacaggaaaagaagatgacaggaaaagatgccatcacctgtgagctgtggctcctcttggaggctccctctggaactaacaggaaggaagcatgttccccagtgatcaggtctatgcagcccatcctctaaggccaagggggctgagaggctaaagaaaaaggctgacaaacccagtttctctg

SEQ ID NO: 1515 - DNA, 436 bp, Homo sapiens
gatacagcctaccctctaggaggaaccactaggatagctgactgagaaccctggttcaagaagtagggtaagtgtcttcttctggctgtttcctgtcactagaacaccagcattgctggagcaagctcgggttgcagcctcaagagaagtccgctctatctttgctaatttacattgtgatgaattaggctgagtggcccaggggaaagtgaaagtgagttaaacaaatttgtctctcttgaaaaaggaagcaggactaaggcagagacattcattcaacaaccagtgagaagcaaagcatgccctcaccctgccctcaggtatgatgggaggacacagaccataatcctgcgaatgtgagcatccgcagagaggcctggcagccacatggctctgtgtgacacaggctcaactccaagcatcagagtctgccaac

SEQ ID NO: 1516 - DNA, 845 bp, Homo sapiens
  misc_feature (823)..(823): n is a, c, g, or t
gagagatttaaattttttaaactgtttttgtaataaatctggcatgtattttacactcaagcatatctcaattcagatgtgaaattttcattggaaatacttgatctgtatttagagtttacagaacttacaattgaaaaagtagagtcacaaacccaattttttctagacatacttcaaagttttctaataactgagtatcaattaattaaagtaaaattcagttcctcggttgcactgaccacattttaagtgctcagtagctagtgggtcctgtattacccaggagcagactatcctttttaatagttgcatacgtttatttgctgataatgtttattgagtgcttactatattgttggctactgttaatcaggcttcatgtgttacctctattaatccctacaatgattctaaaagatattattctaaatgtacagaagaaatagaaacttagtgcagctattaaaaagcataactaagtcttaaacctaggtctttgacatgaaagatcatgctgtttccctctcctttaatgtggctctgttatgatttatttaatcattgacctaccagtagatattttggttattgtttattagtggaaattgcaaaccatgcttcagtgaccatctttgtgagcataacttacataattgtttcgtaaaaaattcaatgagaatacacattttaaatattcattgccagtcatgatgggctcatgcctgtaatcctaggactttgggaggccaaagcaggaagatcagttgaattcaggagttcaagaccagcttgggcaacatagtgagacctcaactctacnaaaaaaaacatacaggaataag

SEQ ID NO: 1517 - DNA, 411 bp, Homo sapiens
caggggattggtaatggggtataaatcctctctctcgtcagcacttcatttttagcagtgtctatctaatggctgtcatcgccacttagattcagagaccagcatgggaggaattgatggttgggtatggtttagaatgttgcagtccatatgccaaagagcatcaccatcagaaccttcttcacctttctggtgaagaagttaggggtttaaacacaaaagctaaatctgatattcacctgacccaagccagttagttccaagtttggctgggcaaattgttaattactcttggtagtagacttcgtgatatttgaatttggactgagagaaattcattttcttgtttaaataaatatccacatagttgaactattttgaagaagtttgaaatctgtttcaagcttaagt

SEQ ID NO: 1518 - DNA, 491 bp, Homo sapiens
accaacctggccaacatgttgaaaccccgtctctacaaacacacaaaaattagccgggcatgattgcgggtgcctgtaatcctagctactcaggaggctgaggcaggagaaactgcttgaacccgggaggcggaggttgcagtgagccgagatcacaccgttacactccaacctgtctaaaaacaaaaacaaaaaacagtaggaaatatgattaggtttaggtttttaaaaaatcctcattggggctgggcatggcggctcacgcctgtaattgcagcactctgggaggctgaggtgggaggatcaactgaggttaggagttcaagaccagcctgaccaacatggagaaacccagtctctactaaaaatacaaaattagccaggtgtggtggcacatgcctgtaatcccagctactcaggaggctgaggcaggagaatcgcttaaacccaggaggcagaggttgctgtgagccgagatcgctccattgcac

SEQ ID NO: 1519 - DNA, 330 bp, Homo sapiens
ctccaagatccaactgtgagacaggaatctagtccagctttctcacttttcagaggagaaaacaaaggctgttttagttagattgtgattccaggataatgcctttcttagaataaaaatttggtctgcagtcttggtcttaaagcccaacttaagtccatatgagaaaaacacaaatgacttgactaaaaatcttagctttaccttgtctaattcagtgactttgggccagtgtaaaagaaattgcctcagacaagttagacaggcaagaaaggttttattctggactatttcagtagaggtcaagattattgcaatgggaaagagaaa

SEQ ID NO: 1520 - DNA, 427 bp, Homo sapiens
gtacaggtggcatttatgctccccacaaaagaaaaagccttaagctgtcctctgaggagatgaagtcttcatgaagaggaggccaaaacctttctgctgttcctctctctcccctctgtgtcatagatcccagctggcaaggaatatgctgctgtccttgtgatccaggcttctggtcagacttgaggacagtgagcactcagtgactttgttgaatgaatatatgagtggatgagctgtcaatgaatgggatgtgaaatagatgttatatatattaatataaagaacctaagaaagatcaaatctggaagtggagatgcaagattattgaggaactcacaaaatgtcagaggcagcaggtggatttctgtaaactacatatctagtcctccttaaaagcagaattctgattcattctaggggaggc

SEQ ID NO: 1521 - DNA, 570 bp, Homo sapiens
attctaggttgtcgacaggagattgggtcctgggaattgcctcatgattcagtctgagacagcggatgtctcttctctcccttcttaatcagttttcttaatgtagctgctagtggggcaagtataaccaccaatcctcaggtgaagcctcttagttgttccctgggagtggacgcctcagctcctggctctgcccactaatgtggcctgtgcacacactgcagctgagcagtccaggttggagagaaaaaagaaaaaacaaagcgaatcccaccccactaaccttggagcaggaaacactcctgcagaccctgccttacagagaagagaatacttgaaatatgacactcggggaattggtaacaccaggaggctgtttctactgtttgctgcatgatttgcagcttcaattggactactttttctaacaggaagaaatgagccttgggaataccaggacgaatatatatagtctacagactctgaaacaaagctgttataaaattattggatacaacttaaagtaagggaatagtctgtttttattagaagatgatccttctgtgtaaa

SEQ ID NO: 1522 - DNA, 450 bp, Homo sapiens
cataacacagatcataccaccatcattcattcattaaaacatttcttcatcacctactgtgtgcaagacttgggactaggagcagagaattcttaatccctgcacacggggaacctaagcctcatagaggaaataagcgtaacagtgaatcgttagtgagtgtctgctgtatgccaaggagcatacgtatgttaccttatttaattttatttcatcctcacagcaatcctatgatcatcctcattgtatgaatgagaagactcagatgcagagaagttgagtcagacttctagttaatgaggaagtcagtttaaatgaacaatatgtaagtctgggcacagtgggcatgtgtgtgtagccccagctactccggaaggctgagggcaagagggatccactttgagtttcagggagtttcaagactgtattaggtgcactattaattatgcc

SEQ ID NO: 1523 - DNA, 1414 bp, Homo sapiens
ggatttaattgattatgtagaacaatttgggggccatttgacatcattaaaatattcaattttcctattcattaacatggtatatctcttcactttaagtcttttgtatgtttctcagaactatttttgtggttttcagtaaagtgttcttgcacatccttcaatagatttattcttagacgttttatatttgtttatggctagtatatacagattctgttgctacaaaactatgttgaccttgttatccagtgagtggccttgtgacattcatttaaattataataatttgcagattatttttgtataatcatgtcctctgtgaatgacagttttatttcttcctttcttaatctttatgccttatttagctcttgccaaactgcaggggctgagcaattggacaagataaagaaataaaagtgatccagatcataaagaaagaagtaaaactatatctgcacatgacataatcttgtctatggaaaatcctaaggaatccacacacaaaaaaactactagagctaataagttcagcaaggttgcaagatataaaattggtatacaaattgcagtggctaggacctccagcagaatgctgactataagtagtgatagtgggtattcttgtctcatcctcaatctcaggggtggtgggtgtggcatgtggagagttgtcaatattcaccatgaagtttgatggttgttataggatttttaatgtactcattaacatatattctcaagctgttaaaaagattttttttaattacaaatgaggttaaatttctctcaaatacttattctgcaccttttgaaataattttatttttctcctttattctttggatgtgatgacttatactaattgactgttgaatgtcaaaccaaacttaacattcttgtaatagaaaccagcagggtgtgtacgcgtttgtgtgtgtgcacaggtttatacacataaacacaataatacttggacttatttatttaaaatttagatttattagagggagcatggccataaaataaaataaaataaaatttagatttaagtcaagctcagtggctcacatctattatcccagcactttggaaggccaaggcaggtagattgtctaagctcaggaatttgagaccaacgtggtgaaactcggtctctacaaaaaccacaaaaattaggccaggtatggtgtcacatgcctgttgtcccagctacttggagggctggggcaggagtattgcgtgagcccaggaggttaaggctgaagtgagtcatgttcacgccactgcactacagcctggataacaaagcgagactctgtctccaaaaataaaataagtaaataaataaataaataaaatttagattaatttgctgttatatttttatataaactatgacataagtata

SEQ ID NO: 1524 - DNA, 432 bp, Homo sapiens
tggtctcagcctaatggctttctgaattaatttttttaaaacagtgtagaaactaaagctttataatgtttacataggaagatttttttttaatttttattttataaagcagaggagtgagttaagaatcatttcaaagaaagaattggccttggctgggtgcagtggctcatgcctgtaatcttggcactttggtaggctcaggtgggaggatcgcttgaggccaggagttcgagaccagcctggccaacatggtgaagccccgtctcctaaaagtacaagatttagccaagcatggtggcacacagttttgatcccagctacttgggaggctgaggcgggagactcgcttgaacccgggaggcagaggttgcagtgagccaagattgagccactgcactccatcctgggcaacagagccagcaaaaaaaa

SEQ ID NO: 1525 - DNA, 376 bp, Homo sapiens
ggttgcagtgagccgagatcatgccactgcactccagcctgggagacagaaagagactgtatcttaaaaaaaaaaaaaattatattcagtacagccataaaaagcaagaaacagccaggcgtggtggcttatgcctgtaatcccagcactttgggaggccaaggcaggcagatcacaaggtcaggagatcaagaccaccctggccaacatggtgaaagcccgtctctatttaaaatacaaaaattagccgggtgtggcgatgcacacctgtagtcccagctactcgggaggctgaggcaggaaaattgcttgaacctgggaggcggaggctgtagtgaaccgagtttgtgccactgcactccagcctgggtgacag

SEQ ID NO: 1526 - DNA, 495 bp, Homo sapiens
tttttttttcttttttgtggtttttatgttgacaacacgaaaatacattgcagtgattttggtcctactcaggcctcagtttgggggccagctctaccacaaaccagctttttgaactttttgaccctgagtaagttattttatctctctaaatccctgttttcttataagcttaaaagtctgaaataaaaaataccataagtagttattgggaataaataatatatgcaataacagtatgaataaaaaaataccatgagtagttattgggaagaaataatgtatgcaaggtaccttgtacataattggtgcttattaaatgttagtctccgctcttccgtttaataagcctgttatgcctaataacaactggaagtcagtctttggtaaaaatatgaaaggaacagagaggaatgaaagaatttgaatgggccaggaatgtaaaagatggtaaagtttccttaaattgtggggcaatcatatattgatttttct

SEQ ID NO: 1527 - DNA, 470 bp, Homo sapiens
ttctctaattttatttatatatagtctaccagaagaccaactgtagctttttaaatatatgtgacatatatctggtacagcgaggtgtctcacgcctataattccagcactttgggaggccaaggcggacggatcactggagcccaggagttcaagaccagcctggtcaacatagccaaaccccttctctattaaataaataaatatatatgtgacatatatctaagtagcatagatgatattatttatgattttccctacacattatctttatagatgtcagctggtaagatttttttggctcaagtcagcctcattctaagaccaagtcagtcagtcacattctgagaccattcacagaccttcttgccttgtgttgccacttgtattgtcttatattgccacttacaagaggcatggtaggttaaagttcatttaattgttatcataaatgaaatgtaagtgattgt

SEQ ID NO: 1528 - DNA, 357 bp, Homo sapiens
tttttttttttgagatagagtcttgctctgtcgcagtggcacgatcttggatgtctgtaatctccgcctcccaggttcaagcaattctcctgcctcagcctcctgagtagctgggactcggcgcacatcaccacactcggctaatttttctatttttgctagagacggggtttcaccatactggtctggctggtctcaaactcctgacctcaggtgatccaccagcctcagcctaccaaagtgctgggagtaaaggcatgagccgccatgctcagccacaattttttaatgtaagtaatttttacttctttagaaaaattatatgactagcacaccatgtctaataaaaggataatt

SEQ ID NO: 1529 - DNA, 4246 bp, Homo sapiens
cccagatttggtcatgacagtaatggaagcaatctccattcttttgaatgccaagcctgattggccatcagcaaagcaacttcttggtgactctaactttctaaaaaggcttttagaatatgataaggagaacataaagcctcagatattggcaaagcttcaaaagtatattaataatcctgattttgtgcctgaaaaagtggagaaagtgtccaaagcatgtaaatctatgtgcatgtgggtaagagctatggatttgtactctcgagtggtcaaggtcgtcgaaccaaaaagacaaaagctccgcgccgcacaggctgaacttgacattaccatggctaccctgagagaaaagcaagcattactaagacaagtagaagatcaaatacaggccttacaagatgaatatgacaaaggtgtaaatgaaaaagaaagcctggcaaagaccatggccctgacaaaagcacgtctagtacgtgctggaaagctgacagcagcattagaagatgagcaggttcgatgggaagaaagcatacagaagtttgaggaagaaatatcaaatatcactgggaacgtgttcatagcagcagcttgtgtggcctactatggggctttcacagcccagtacaggcagtcacttatagagtgttggatccaggactgtcagtctctggagatcccaatcgatccttccttcagtctcattaacattcttggagatccctacgagatacggcagtggaacactgatgggctgccccgtgacttgatatcaacagaaaatggcattttggttactcaaggcagaagatggcctttgatgattgatccccaagatcaggcaaaccgttggataaggaacaaggaaagcaaaagtggtttaaagatcattaagcttacagatagtaatttcttacgaatactcgagaattcaatccgacttggtttacctgtcttactggaagagcttaaggaaaccttggatccagctctagaacccattcttttgaaacaaatttttatcagtggtggccgactactcatccgtcttggagactcagacattgattatgacaaaaactttaggttctatatgacaaccaaaatgccaaatccccactatctgcctgaggtatgcattaaagttaccattatcaatttcactgtaacaaaatcaggcctggaggatcagttgttaagtgatgtggtgcgacttgaaaaacccaggttggaagaacaaagaattaagctcatcgtgaggatcaacactgataaaaaccagttgaaaactatcgaagagaaaatcctgagaatgctctttacctctgaaggaaatattctggacaatgaagaacttattgacacactccaggattcaaagatcacttctggtgccattaaaaccaggctggaagaagcagagtccactgagcagatgatcaatgtggctcgtgagaagtatcgtccagtggccactcaaggctctgtaatgtactttgtcattgcaagcctctcagaaatagatcctatgtaccagtactcattaaaatactttaaacagttgttcaataccaccattgaaacttctgtaaagacagaaaatctacaacagcgcctggacgtactactagaacaaactctcctaactgcttatgtcaatgtttcaagaggactttttgagcaacataaactcatctacagctttatgctttgtgttgagatgatgcgtcagcaaggaaccctatctgatgctgaatggaatttctttctccgaggttctgcaggattggaaaaggaacgcccacctaagcctgaagctccctggctacctactgctacatggttcgcatgctgtgacttggaagaatcatttccagtttttcacggacttacccaaaatatattgtcacatcctatttccatacgcttaggatcttttgagacttatattaacccacagaaatgggaaggctattctaaaatgaaacacgaagataaacacatgagacaggaaaaggaggcagcacaccaagatccatggagtgcaggattgagttctttccataagctaattcttattaaatgttgtaaagaagaaaaggtggtttttgctcttacagactttgtgatagaaaatcttggaaaacagtttatagagacaccacctgtggacctgcctaccctgtatcaagacatgtcatgcaacactcccctggtattcatcctaagcacaggctcagatcccatgggtgcatttcagaggtttgccagggaaagtggatattcagaacgggtgcagtcaatttcactggggcaaggacaaggacctattgctgaaaaaatggtcaaggatgcaatgaaatcaggaaactgggtatttttgcaaaattgccatcttgctgtttcttggatgttggcaatggaagagctcattaaaaccttcacagatccagatagtgctatcaaggacacttttcgactttttttaagctccatgcctagtaatacatttcctgttacagttcttcaaaattctgtcaaggtgaccaatgagcctccaaaaggcttacgtgcaaatatcagacgagcatttactgaaatgacaccttcgttttttgaagaaaatatacttggaaaaaaatggagacaaataatatttggcatttgtttcttccatgcaattattcaggagagaaagaagtttggcccccttggttggaatatctgctatgaatttaatgacagtgacagggaatgtgctttactgaatctcaaactctattgtaaagaaggaaagattccctgggatgcactaatttacattactggtgaaattacttatggtggtagagtcacagacagctgggaccaaagatgccttcgtactatcttgaaaagatttttttctcctgaaacattagaagaagattataaatactctgaatcaggcatctattttgcacccatggctgacagcctacaagagtttaaggactacattgaaaatctgcctttgatcgatgacccagaaatttttggaatgcatgaaaatgctaatctagtcttccagtacaaagagaccagcactttaatcaacaccatacttgaggttcagccaaggtcatctactggtggagagggaaaaagcaatgacgaaattgttcaagaacttgttgcttctgtccagaccagagttccagaaaaactggaaatggagggtgcttctgagagcctttttgtcaaggatcttcaaggacgtctgaactccttgaccaccgttcttggacaggaagtggaccggtttaacaacctgctgaagttaattcatacttctctggaaacactcaacaaagccatcgctggatttgtggtgatgtctgaagaaatggaaaaagtgtataacagtttcctcaacaaccaggttcccgctctgtggtccaacacagcctacccatccctgaagccactaggatcatgggtcaaagaccttatcctgaggacctcatttgtggatctgtggctcaaaagaggacagcctaagtcctactggatctctggtttcttctttcctcaaggatttctaacaggaactcttcaaaatcatgctcgaaaatacaatttgcctatagatgagctgagtttcaaatacagcgtaattcccacctatcgggatcaagctgcagtgatagaagctgccaagacagtgcaatttggacaagaactgcccatggacatggagttgccctctcctgaggatggtgttcttgttcatgggatgttcatggatgcttctcgatgggatgataaggagatggtgatagaagatgcattgcccggacagatgaatccagtgctgcctgtggtgcattttgaaccacaacaaaactataagccaagcccaacactttaccactgcccactttataaaacaggagcccgggcaggaacactctcaaccacaggacattcaaccaattttgtggtaaccgtcctgttaccctccaagcggtccaaagactactggattgccaagggatcagctttgctctgccagctgagcgaatgaaaaggtgccacctcagccctgaaaaagaaccaggccagagatctttcctaatgggagcaaaaggtttgaataatttatatgtgagcaaaacggtgttaattctgatttgacttaaacgtattgtgacttttatttctcttatgaccttaaaataaagtgtttgagttctttctgttggca

SEQ ID NO: 1530 - DNA, 2049 bp, Homo sapiens
cactggcagagacataatttagatatctgaactttggttttagtgatgtggtgcgacttgaaaaacccaggttggaagaacaaagaattaagctcatcgtgaggatcaacactgataaaaaccagttgaaaactatcgaagagaaaatcctgagaatgctctttacctctgaaggaaatattctggacaatgaagaacttattgacacactccaggattcaaagatcacttctggtgccattaaaaccaggctggaagaagcagagtccactgagcagatgatcaatgtggctcgtgagaagtatcgtccagtggccactcaaggctctgtaatgtactttgtcattgcaagcctctcagaaatagatcctatgtaccagtactcattaaaatactttaaacagttgttcaataccaccattgaaacttctgtaaagacagaaaatctacaacagcgcctggacgtactactagaacaaactctcctaactgcttatgtcaatgtttcaagaggactttttgagcaacataaactcatctacagctttatgctttgtgttgagatgatgcgtcagcaaggaaccctatctgatgctgaatggaatttctttctccgaggttctgcaggattggaaaaggaacgcccacctaagcctgaagctccctggctacctactgctacatggttcgcatgctgtgacttggaagaatcatttccagtttttcacggacttacccaaaatatattgtcacatcctatttccatacgcttaggatcttttgagacttatattaacccacagaaatgggaaggctattctaaaatgaaacacgaagataaacacatgagacaggaaaaggaggcagcacaccaagatccatggagtgcaggattgagttctttccataagctaattcttattaaatgttgtaaagaagaaaaggtggtttttgctcttacagactttgtgatagaaaatcttggaaaacagtttatagagacaccacctgtggacctgcctaccctgtatcaagacatgtcatgcaacactcccctggtattcatcctaagcacaggctcagatcccatgggtgcatttcagaggtttgccagggaaagtggatattcagaacgggtgcagtcaatttcactggggcaaggacaaggacctattgctgaaaaaatggtcaaggatgcaatgaaatcaggaaactgggtatttttgcaaaattgccatcttgctgtttcttggatgttggcaatggaagagctcattaaaaccttcacagatccagatagtgctatcaaggacacttttcgactttttttaagctccatgcctagtaatacatttcctgttacagttcttcaaaattctgtcaaggtgaccaatgagcctccaaaaggcttacgtgcaaatatcagacgagcatttactgaaatgacaccttcgttttttgaagaaaatatacttggaaaaaaatggagacaaataatatttggcatttgtttcttccatgcaattattcaggagagaaagaagtttggcccccttggttggaatatctgctatgaatttaatgacagtgacagggaatgtgctttactgaatctcaaactctattgtaaagaaggaaagattccctgggatgcactaatttacattactggtgaaattacttatggtggtagagtcacagacagctgggaccaaagatgccttcgtactatcttgaaaagatttttttctcctgaaacattagaagaagattataaatactctgaatcaggcatctattttgcacccatggctgacagcctacaagagtttaaggactacattgaaaatctgcctttgatcgatgacccagaaatttttggaatgcatgaaaatgctaatctagtcttccaggtatgtggcctttcatcttaaaatacatatttatgttgtgtatgtaaactcaaaacatcaataatcacccccactcactctggaaattataatcttcctaaataaacaaataaaataattgtttcaccttgacttc

SEQ ID NO: 1531 - DNA, 652 bp, Homo sapiens
tttcttctaaagctttcgctttctagccatttattatgctctgaagcaaatgttctgctctgtgcttttccaaacaggcaaaccgttggataaggaacaaggaaagcaaaagtggtttaaagatcattaagcttacagatagtaatttcttacgaatactcgagaattcaatccgacttggtttacctgtcttactggaagaggtttgattttcacttccttttctcatgtcagttcccaactttcaaatcatatctggaatcctatataggccacatccccatcatgctaaagacaccagtcaactccattttcaaattggtcaaaccagttcctcttctccttaaacaatacattatcacattgcaagaggggtgggagggaggacctgttgactttcagacattgttttagtgttaagagggctggcctctgtttcctgacactgctgtttcacaggcctcattatggcccttgatggtgagctgcgctgaaaattcacaacagtagtgcagtcaggattatgtacatacaataatgatgcgaagccagtaaaatattctagtggatacaaacattattttttacttgggcataagtcagaattggattaagtgaattagataagaattaacttttgttaaaaaaaaaa

SEQ ID NO: 1532 - DNA, 4612 bp, Homo sapiens
  misc_feature (3952)..(3952): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1533 - DNA, 4432 bp, Homo sapiens
  misc_feature (24)..(24): n is a, c, g, or t
  misc_feature (29)..(29): n is a, c, g, or t
  misc_feature (31)..(31): n is a, c, g, or t
  misc_feature (3772)..(3772): n is a, c, g, or t
accctcagggctaggtacgaggcngggtntnctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1534 - DNA, 4658 bp, Homo sapiens
  misc_feature (3952)..(3952): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctccaaaacaagaaatgtgataattctagtgtcctgtgcacgaatatcct

SEQ ID NO: 1535 - DNA, 2870 bp, Homo sapiens
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaa

SEQ ID NO: 1536 - DNA, 4587 bp, Homo sapiens
  misc_feature (3952)..(3952): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgtgctaacgactacgggatcctctaga

SEQ ID NO: 1537 - DNA, 4510 bp, Homo sapiens
  misc_feature (3952)..(3952): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacgcgtgagggcattgaaagactcgatatggggatcctctag

SEQ ID NO: 1538 - DNA, 2934 bp, Homo sapiens
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaatgctttcttctctatcggaaataaccggaggataaattactgttctttcttttttttttttttt

SEQ ID NO: 1539 - DNA, 4525 bp, Homo sapiens
  misc_feature (3865)..(3865): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacaggattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1540 - DNA, 4327 bp, Homo sapiens
  misc_feature (16)..(16): n is a, c, g, or t
  misc_feature (19)..(19): n is a, c, g, or t
  misc_feature (27)..(27): n is a, c, g, or t
  misc_feature (3667)..(3667): n is a, c, g, or t
tgcaggctggtaccgnccncgggtatngatggggcatgacccatccccagtttttgcaggctgacatccgcttgaattgcccatttttttctatctctgagtcgtgagtcgcgagttaggcctggaggtgccattaccccatcagtaggcgcctttccaccttctgagatggatgcatgagcctgtctcacccactcactgctgaggtgcctgtctctccctaaggttgctgtcttcctcgtccctccggcccttcttcctactcagcgtctcacttttggcctattttctgctggatctctggcagcctcgctttctccctgacgtttcagcatcatccccagaggagccacactctgacaggattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1541 - DNA, 4524 bp, Homo sapiens
  misc_feature (3864)..(3864): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgattctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1542 - DNA, 4360 bp, Homo sapiens
  misc_feature (3700)..(3700): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1543 - DNA, 4426 bp, Homo sapiens
  misc_feature (3766)..(3766): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccagcaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1544 - DNA, 2668 bp, Homo sapiens
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattgaaagtttcttttaagatggaattcataaaagggaaaat

SEQ ID NO: 1545 - DNA, 3246 bp, Homo sapiens
  misc_feature (2586)..(2586): n is a, c, g, or t
gctggtacggtcccgagtcttaggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1546 - DNA, 2639 bp, Homo sapiens
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcagcccgacgttacattcccacccccagttccgtcggagaagtaatctgtggctgcataggaatctcgggtgtgtgggtaacggggaggcagggagcggaaagcatggatgtaatcagtgggcctgaagttcattcgtgcccgcggtgccaagagacccttcccttcagaagttcccctctaggggttcttagagcaaggttcccccctcccacctcaaccttcccttaaaaaaataaaaaggctggtttcttccgggccagatattggccacttaaaaaaaaa

SEQ ID NO: 1547 - DNA, 3615 bp, Homo sapiens
  misc_feature (2955)..(2955): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccacagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1548 - DNA, 2148 bp, Homo sapiens
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcccggacgcgtgggtcgacccacgcgtccg

SEQ ID NO: 1549 - DNA, 2769 bp, Homo sapiens
  misc_feature (2109)..(2109): n is a, c, g, or t
aaccatacggctaggaacgaggcggggggtggaatcggcaccgaggcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1550 - DNA, 2637 bp, Homo sapiens
  misc_feature (1977)..(1977): n is a, c, g, or t
ggacggccgtgggtcgacccacgcgtcggtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1551 - DNA, 3156 bp, Homo sapiens
  misc_feature (2496)..(2496): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtctcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1552 - DNA, 2768 bp, Homo sapiens
  misc_feature (2108)..(2108): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccacatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1553 - DNA, 726 bp, Homo sapiens
acctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggtaacggccgcggaggagggggcggggccgggatgagcgggggagggaggggtcgagagcaccattcccctttctgggttatcacttggcctgggggcatgacccatccccagtttttgcaggctgacatccgcttgaattgcccatttttttctatctctgagtcgtgagtcgcgagttaggcctggaggtgccattaccccatcagtaggcgcctttccaccttctgagatggatgcatgagcctgtctcacccactcactgctgaggtgcctgtctctccctaaggttgctgtcttcctcgtccctccggcccttcttcctactcagcgtctcacttt

SEQ ID NO: 1554 - DNA, 4576 bp, Homo sapiens
  misc_feature (3916)..(3916): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1555 - DNA, 3049 bp, Homo sapiens
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggagggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattgaaaaaaaaaaaaaaaaaaaaaaaagagggggggcgcggctctaataaaggtatttccctcttgggggggcccaaggttttaggcgttaccacggtttttttgtacaaggggggctccctatatataggggaggtcggtattataaaaggcaagggcaggggccggcggtttaaaaaggtggggagtgggggaaacacggtggctaggctggggagatctgggggaagggagcccttacttcgtgggggtgggtgacattattggggcgcaaactacctacaggagattaaaaggctcaaaggtaaaatataaaatttttcacggtggtattagtggtgtacacctagctgaatatgctggcggctaggaaaagtttggtaacggggtatgactttctggaatttttttccccaggactg

SEQ ID NO: 1556 - DNA, 3549 bp, Homo sapiens
  misc_feature (2889)..(2889): n is a, c, g, or t
ttagcagtagcagcagcatgtccctggccaagggagtagatttctccagactactaaagccatgtatatagccattcccacttcccatattctgtggatatgtacatgtgcatggtagctagagtccctccaccagagtatctctctcatgatggtttcttcaggggagagctggcccctcccgaagacctactaggccgtcctcaagctctgtcaaggcaagccctggactcggaggaagaggaagaggatgtggcagctaaggaaaccttgttgcggctctcatcccccctccactttgtgaacacgcacttcaatggggcagggtcccccccagatggagtgaaatgctcccctggaggaccagtggagacactgagccccgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1557 - DNA, 3837 bp, Homo sapiens
  misc_feature (3177)..(3177): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1558 - DNA, 3280 bp, Homo sapiens
  misc_feature (2620)..(2620): n is a, c, g, or t
tccatcttggggggaccctgccccattgaagtgcgtgttcacaaagtggagtgaaatgctccactggtcctccaggggagcatttcactccatcttggggggaccctgccccattgagacagtgagtggtggcctcactgctctgcccggcaccctgtcacctccactttgccttgttggaagtgacccagccccctccccttccattctcccacctgttccccaggactcaccccagcccctgcctgcccctgaggaagaagaggcactcaccactgaggactttgagttgctggatcagggggagctggagcagctgaatgcagagctgggcttggagccagagacaccgccaaaaccccctgatgctccacccctggggcccgacatccattctctggtacagtcagaccaagaagctcaggccgtggcagagccatgagccagccgttgaggaaggagctgcaggcacagtagggcttcctggctaggagtgttgctgtttcctcctttgcctaccactctggggtggggcagtgtgtggggaagctggctgtcggatggtagctattccaccctctgcctgcctgcctgcctgctgtcctgggcatggtgcagtacctgtgcctaggattggttttaaatttgtaaataattttccatttgggttagtggatgtgaacagggctagggaagtccttcccacagcctgcgcttgcctccctgcctcatctctattctcattccactatgccccaagccctggtggtctggccctttctttttcctcctatcctcagggacctgtgctgctctgccctcatgtcccacttggttgtttagttgaggcactttataatttttctcttgtcttgtgttcctttctgctttatttccctgctgtgtcctgtccttagcagctcaaccccatcctttgccagctcctcctatcccgtgggcactggccaagctttagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1559 - DNA, 3062 bp, Homo sapiens
  misc_feature (2402)..(2402): n is a, c, g, or t
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggaggctcctggtctgggaagtaaagagtaaacctggggcagtgggtcaggccagtagttacactcttaggtcactgtagtctgtgtaaccttcactgcatccttgccccattcagcccggcctttcatgatgcaggagagcagggatcccgcagtacatggcgccagcactggagttggtgagcatgtgctctctcttgagattaggagcttccttactgctcctctgggtgatccaagtgtagtgggaccccctactagggtcaggaagtggacactaacatctgtgcaggtgttgacttgaaaaataaagtgttgattggctagaactgctgcctccctgactgtgagctgccttccacaccctgcactgcactgtgttctctcctcacccttaacctgcttcactccagtctgttctggctgtttattaccttgttgcaaaacagggccgaagcaaggattaccttgacaaccctagcttctccttagccatcttccttgacagtgtgatctgtttagtgagatttagcatgtgtgaataaagtatatgcaggaggaaattgctttgtcttcccaatcggtagaaattcgggaccataaaaattgtgttttaccatgtggcctacaaccttaacactgctttcttaagaagtcttcacccatctacatgctaacaactcactcagcctggatttatctttactggggaagccaaacaagcaatagaggacctttacctgtgttagaaatgagttggagccaaggaacactgaagaaatagtatcttaacagttactgagtccattgtatgtgcttggctctgctctgagtgatttatatgtattaagatttttcctcacaggtcagatatatactgttactaacttcattttatagacaggttaagcttcctgaaggccacaggtcccagtaaattgtggagccagaacccaaacccaagaagttttggcttcagcaaatgcatcagacagcccctgtccattaatagggcacaggtaggaagatgcacaaggatgtgggaactatagagaaccaatctgatgccttggcttaacaaagagtggacatggcaagccttcctcttcggggaagaaaagcccagaactgagcagatggcctcctttatgagttcatgtcctccgccttcagctggaggtaccatatggcgatgctacctgtctttctgctggaggtaccatatggtaatgctgcctgtctgtctgctggaggtaccatatggtaatgctgcctgtctttctgaggttgacttttatgccatgtctttcctaagtgtgtaagaatttttctgtttgcttcacatttgactgagaatcattctagggtttgattgagcccctgtcctgtgccactaaaggaactcgaacttttcatcacttagagatttcagaggggaatggaaaaacagttctaatcaataagcaagcaattcaagaaaaatagaattaatcaggcaatggctgcaacatgtcctatctttaatctattttcttattaagcttggacattgacaatagaaccagaagcttgtagctggatcaaaatattctccataggcctggagtttcatgagggtctattcttttgttgttgttgttttgnttttttgttttttgtgggtttttttttttttttttttgagacggagtcttgttctgttgcccaggctggagtgcaatggtgcagtcttggttcactgcaacctctgcctcccaggttcaaacaattctcccgcctcagccgtccaagtagctgggatcacaggtgcatgccacgatgcccggctatcttctgtatttttagtagaggtggggttcaccatgttggccaggctggtctcgaactcctgacctcaggtgattcacccacctcggcctcccaaagtgctgggattacaggtgtgagccacggcgcccagcctcatgagggtctattctttacattcaccatggtctgatggttgctacatgtttgtctatgattttttttttctattatcaggtgtcttggccggttcatgccccacgatgaaagggccagaggttttcatatgagtaaaagaaaaaagcagaaatgtgaaacctacaattaggctaaacaaaaatcaactggaaaagtacaggctgaggggagaagagttggctacatgtttatgttaggggaggagggagtacattttagctatgtattcaaacagctaatagtttaatgttgctgcttataaacttaattttaggctgcattaataaaagtgtagtctcc

SEQ ID NO: 1560 - DNA, 1264 bp, Homo sapiens
acgggctcagctccgcagtcacgtgacgctcgtccgcaacctctgctgtcctccgcggcgcccccttccgcctgacgcgcccccggcggcggccgcgcagccctggctcctcgcgggctcgggcggcggctgcggcggggctatggcgagcggcggtggcgggggtaacactggcgcgggtggggggccggggatgggcctgagcctgggcctgggtctgggtctgagcctaggcatgagtgaggccaccagtgaggcagaggaggaggcggccacggccgaggcggtgggacgcctggccacgacgctgtggctgcggctccgcggctgggaggcggtgctggcggcggcgcagcggttgctggtgtgggagaagccgctgcacagcctggtcacggcggccgcgctcaacggcctcttctggttgctgtcttcctcgtccctccggcccttcttcctactcagcgtctcacttttggcctattttctgctggatctctggcagcctcgctttctccctgacgtttcagcatcatccccagaggagccacactctgacagtgagggtgcggggtcaggcgcccggccgcacctgctgagtgtgcccgagttgtgcagatacctggctgagagctggctcaccttccagattcacctgcaggagctgctgcagtacaagaggcagaatccagctcagttctgcgttcgagtctgctctggctgtgctgtgttggctgtgttgggacactatgttccagggattatgatttcctacattgtcttgttgagtatcctgctgtggcccctggtggtttatcatgagctgatccagaggatgtacactcgcctggagcccctgctcatgcagctggactacagcatgaaggcagaagccaatgccctgcatcacaaacacgacaagaggaagcgtcaggggaagaatgcacccccaggaggtgatgagccactggcagagacagagagtgaaagcgaggcagagctggctggcttctccccagtggtggatgtgaagaaaacagcattggccttggccattacagactcagagctgtcagatgaggaggcttctatcttggagagtggtggcttctccgtatcccgggccacaactccgcagctgactgatgtctccgaggatttggaccagcagagcctgccaagtgaaccagaggagaccctaagccgggacctaggggagggagaggaagaaggtcacgcgggatcctcagagtcaccgcaagca

SEQ ID NO: 1561 - DNA, 774 bp, Homo sapiens
  misc_feature (24)..(24): n is a, c, g, or t
tcaaagctgtttccgtgagaaagngctcctcctgctcattttagtgccctgaaatgtcacttccttgaggaagtcttccttgaccctccacaccaaaccaggccccctgccacacccctcagagctctccttggaaggcactggcatggctgtttgcgtgattccttgaacgttgtctgtctctcctcctcaccaggctgtgggtcctgtctgtttctggtgaccgttgtctgtctaacccctagaggagagtttgtcacatggtaggagcttaataaatatgtgttggatgaatgatcagagaaaagagagtgcagagagtggccaaaacagatgctttcagcagtgtatctgccaataaacctaaaggcatgatttgccctggtgatccccccagaggtgcttagtctcttggctgaattccttctggaatccccagaatccccctccttggaagttttcccaggagtctgaggcaggcaggtctctcagtcacggccacatgacctcaagtgaaaacaaaccagtctggctgttcacagactcagctggtcagagctctggcccgaggggcccacgcaccacccgccactgcagaagacgcctccacgtctgtctctgggctgcctccaccttctgcaggcctcctggagcctctgctggctgcagaagtggggtgcatgctgcctggaggaggaacatctgtggtgggaccccaaatccatgtttgtgttaccatcgtgttccaataaaactatcgaaacagaaaatgcc

SEQ ID NO: 1562 - DNA, 508 bp, Homo sapiens
aagagaccacaggacatgaaagaactacttttctttctgtagccaacacacattaaaggtcactattctgcgttaacttgaaaagagcaaaagcactgtttaacacaggctgtccagactcaattttagaggcaggaaacagaaattagtcaagtcctctaatttatagatggaaaaactattgtccaaaagtttctttcaatgaatctgttttgaacatttattgtgagatattaccaagatgcatgattgtatgtctcttcaagccagcagaatatttatcacacactatatttcctcaagaaattcttaataagtaaacaaatgaatgaattcacagacttgccccatgttagaaattagtaactagaagaactagagctagaacacccatctcctgacttcctgtttactacttctgggtgagaccaaaaatgcttgaaaatagctaggaaaactcaagcagttttcttagattagcttctgaatcactgatttaagcccatgc

SEQ ID NO: 1563 - DNA, 700 bp, Homo sapiens
ggccacccctcacctcctctaggaggtgtgcagccctagacaaggccatggactggtactgggggtcaaggacccctgctttagggcatgaaacagactgatagctactggtagctgccaacggtatgaatgaagatgttcaattcttctacagaaaaattcttcaccttcacaattgatggaatgtagtagaaatttctgtttgactcttccatggtatatttcagactcactgatttatctaaatatatatattttttatggaactcgtcagctatacccatcttcaatcttataagcaaagaaataaattctaaagaatttgtatgatgaagacatatttttgagctgagtggctcctaatcgcccatttttccttgagggagcatttattgagtgtttgttgtatgctggcagtggattccagactgaacaaagcagacactgcccctgctcccggagagcttgcaccgcctccatgcacacaccatcctgctctactgcagctgtcctgatcacctaagaagtgatcatcagattctaagttgtatagcccataacatttcctcattaattcattgaagtttaaacttctcatccatgtgtgtagcaagcttagttctgcaaaaatgtttgaaatttgccacttcctctaaaaaagatattttcttctgtgatcattaattataataaaatgtgt

SEQ ID NO: 1564 - DNA, 344 bp, Homo sapiens
atgaaagtcaaagatgtcatatataattggtctctttacttgtcagtgtattaggttagcttatttactgtgaaaagcatttgatctcaaggaatattttgtgccaaatgaagtgtgtacctggaaacagaaccaggaacaggatttgaagatctaggaggtttactgtagttcagagcgcaccagctctggtctgctcaaagcccctctcaggggtcccaggggtttgtatcacactccaaagcaacatcttatcagattctgcaccaggatgactcagttattaccataatttaggaaaaacagatctagaaacttaaagacgggcaggtcgtagtgattca

SEQ ID NO: 1565 - DNA, 772 bp, Homo sapiens
taaagaaaataagtaaagtttatttctgtttaaagcacagtaagtttcaccatgaaaagttaacatacacatacaacaaacagtaagaacaaagtttcctttaatattcttacatttttggcatttagttgcacaaagttaggatggaacccactgtaggggacagaactcttaatagtgtcttaggatttttctcacattttgttaatctaactgggtgtgttgttatgatagaaagcagtgagctccatggtaatacttgttccctgtgacagaagaaagggacaaagatgtgacatggtcataacccctgcaacctccgaagatgctgctgtgtcctgtcccaggagggctccactctttttagggaatggctatatttacccagtttacagcttacgagaaacacgttgagggcaagactcaaatgaaactaatggggggccgtgaaaggctattttaagaatgcagaaagcagggaaaaaaggtaaaaaaaaaaaaaattaaaagaacagcaacaacaacaacaacaatgaacagtagagaacacaggttagcacactttttctgttaagagccacacagtctctgtcataccacccaactctgaatgtgaaaacagccacagataactgtaagtgaatgtgtgcggctatgttccacatttacaaaaacaggtgggcgggcctgatttggcccatagtttacaatccttggtatagaggattaaaaaatgcccacccctccatccataacacatttcaacggaaag

SEQ ID NO: 1566 - DNA, 418 bp, Homo sapiens
gttggcccttaccagtactacttgttgaataaagaaggaataccgagaagatattaattgtacgacattaagctaatagccagcaacccacatcccatcctcaagagaggtcatcaataaaaatttgttaaggaataattgagtgggctgaattacttaaaaaggtattgaaaatgataaaataaaatcagtgcggaaggataaaaaaaaatggcactgatgaaaaagtgaaatggtgacctcggcctacccgttttgctttctactcaaactgaaagcttttctacccaggaacttttttgcttttaatcataaatggaaatgttttaattggcctctctcactttgattctgaaagagttaccaacaaccaaagaataggagaaataaaatgcaaagataaatttatttttttggc

SEQ ID NO: 1567 - DNA, 427 bp, Homo sapiens
ttggcatcaggacccatcacaaaacacagagccctgagtgttcttcattttttaaataatattttccagatcaatatgctattgaacttttttgctaagaagaaaagattgaaaatgatttataatcatttaatttcactgtcagtctcacaaacaactgattccttatggtaaaagtgttggaaacattatattcaaatagtagtgttaaagattttgcagcaagattgtgggtaaaaaaggctgaaagtgttttgagaggaaaatgaactgcagagtaacaaagaaaaatggtgagcgtcagaattccttagctcttaattattttcatggaaaagtacctagttctcaaatgctggtaactggaacatcctattggttaaaaataaacagcataaagtttcaggaaaccaactaaacagcaaaa

SEQ ID NO: 1568 - DNA, 345 bp, Homo sapiens
tttgagatggagtcttgctctgtcgcccaggctggagtgcaatggcatgatctcagctcactgcaacctctgcctcccaggttcaagtgattctcctgcttcagcctcctgagtagctgggattacaggcacgcaccaccatacccgactaatttttgtatttttagtagagacggggtttcaccatgttggtcaggctggtcttgaactcctgacctcgtgatctgcccacctcagcctcccaaagtgctgggattacaggtgtgagccactgcacccagcctatgatttttcataatattaacttataatcctttttagttctgccaggtctgtaatcatgtc

SEQ ID NO: 1569 - DNA, 443 bp, Homo sapiens
gggattacaggcgtgcgccaccacgcctggctaattttgtatttttttagtagagacaaggtttctccatgttggccaggctggtcttgaactcccgacctcaggtgatctgcccgccttggcctcccaaagtcttgggattacaggcatgagccaccgcacctggccaaacatatttttctttaactgaggaaattagattcattgtccaaagcttaaaaggaagattttctactttgagtttttattaactctgatactttactatgacagtacttccagcctctgagacatgagaaatagcgtgagattgtagtaatcaaaatgaccttaccagaaatcaccaccaggttggtgaaaaacagtacatctacacagaaggatggacttgatgttgattctttcaagattaaagatgaagatgcccgaacttgaagcaagtc

SEQ ID NO: 1570 - DNA, 724 bp, Homo sapiens
tctgtccttttcgtacttggacgtctagttcgccatgttgcctaaagtggaagttccatagctttaaattcaacttagtggtacacttttgtgatgttaaggcacagagaacacaggaaattattccattccaatttcggcttattttataactggaaatgtgtacaggaatttagaaatggaaagtaaggataaatgaaatggttgagaaaagatgacataaaaggaatgaatagtagaaccaaaacaaaacattgagaatcttgtgacagtcttaaatccagtaactaaatagtatttacaaatagaaaaacatgtcctggacaaatcagttaaaagatgcagattctggctgtgacataactggcttattattaaacaatttccgtctcagagcttcaacgtcctcatttgaaaaataaaataataaggccctttgacatcagagttcattgtaacgattaaacacagtaacgtgtatggatttatggtataatgcaatataccaatgcaaagtttaatgaagatacttcaacagtgttgtgcctttaaaaaattgctcttgtgtattgttcaagggaatcgttttttatagtcatttgttaattcattgttcatttattcaaccaaacattcattgagcattttctctgttctagatatgattgatgctagacactggattccccttccccttcaagaacatactatttgttagggaaaa

SEQ ID NO: 1571 - DNA, 2033 bp, Homo sapiens
  misc_feature (143)..(143): n is a, c, g, or t
  misc_feature (223)..(223): n is a, c, g, or t
  misc_feature (393)..(393): n is a, c, g, or t
  misc_feature (456)..(456): n is a, c, g, or t
  misc_feature (1095)..(1095): n is a, c, g, or t
tactcatctcacaccatcagataagatagtgatatgaaaggctgtggaaaactctgaaggaccattacactatattattattatgacagcaattacagggtacttcaaatgtttgtgggaaatagaattaaaggttaaaattnaaatataaactttatttctcaacatacgatttgtcaagttcaagatgataagcaatgataccagccatttagttcatccntaaagaaccgagggtcctgggaattcatgtcaatgcagtcttttttacagtaataatgtaatgttaataacagaagaaaaatgcatgccttttaaagaattgttaagattaggaaacaaaaataagtcagaaggagccaaattaggagtatgaggtggatgcctaacggntttccatcaaaatcctaacaaaattgcctttgtttgatgagaggaatgagcaggagcattatnttggagaaggactctctagtgaagctttattgaacattttcctgctaaagcttttactaactttctcaaaaatactttcataataagcagatgttatcattcattgtccctccagaaagtcaagcaaaatctcttgaacatcccaaaagactgttgccaagacctttgttcttgactgatttgcttttgctttggctggacccttccacctgttggtagccattgctttgattgtgctttgtcttcaggatcataatagtaaggccatgtttcatctgttagaattctttgaagaagtgtacgagtgttttagggtcttgaccctacttgtttaaaatttctattgacagcctttctcttgcctgaaactgatctgggcccaatggtttgggcacccattgagttgaaagtttgctcaactttaatttttcagtcagaattatgtaagcttaaccaattgagatgtctgtggtgttggctcttgtttgtgcggttaatcgtcagtcttcttcaattaggatacaaacaagatattttcctcacaaattgatgtggatggtctgccactgtgggctttatgtttgacatcgtcttgtcccttcttcaaatgagttatccatttgtaaactgcttattttngggggcagggggcattgtccccataaactattcataaagcatcaatgatttcaccattcttccacccaagcttcaccataaacttgaggtttgttcttgcctcaattttaacagaattcatgttgttctgatacgggctcttttcaaactgacgtcttatccttcttagtgctgcaaactgtatcctgttcagatacattataacaagttaatataagtttatgttggtgaaaaaaattgaaatccagcgagacacagtggctcatggctgtaatcccagcactttgggaggccaagacaggtggatcacttgagcccaggaatttgagaccagcctgccaatgtggccaaagcctgtttctactaaaaatacaaaaattagccagatgtggtggtgcgtgcctgtaataccaataatttgggtggctgaggcacaagaatcacttcagcctgggaggcagaagttgcagtgagccaagatggcactccagcctggacaatggagtcaagactctgtctcaaaaagaaaaaaaaaggaaaaattaaaatccatgcatattttttcataatatgcattttccatgaactttttgaagatgccttgtacattttcatagctgctgaaaaaaataggaaaaaaaagtctatacggccaggtgcagtagctcatgtctgtgattccagcactttgggaggccaaggtgggcagataacttgaggccaggagtttgagaccagcctggccaacatggcgaaaccctgtctctactaaaaatacaaaaatgagctgggtgtggtggcgcatgcctgtaatcccagctactcaggaggctgaggcacgagaattgcttgaacctgggaggcagaggctgtagtgagctgagatcgtgccactgcactctagcctgtgtgacacagtgagactctgtctcaaaaaa

SEQ ID NO: 1572 - DNA, 445 bp, Homo sapiens
gattccaattcaactggattggggcggtgcctcagagtctgcatttctaaccaactccagcaagcttgatgctgctgccagtccatggaccaccctgcagacagcaaaggcacaggagatgatgtggaaggttccaggggagaccaacactaagagctgatgaatggggaagagggtggaagacaacagtcaagtgagatggccaacaggagtctttataatgttccagaccagcccgggtaacagtgagacccatctctaaactaaataaattaatttagtatttgttaaagaagagagaggccaggggtggtggctcatgcctgtaatcccagagctttggaaaggcagggcaggaagatcactcgaggccaagagtttgaggctgcagtgagctataatggcaccactgcattatggcctggatgacagagaccctgtctca

SEQ ID NO: 1573 - DNA, 198 bp, Homo sapiens
tttaggaagtgtgtgatatatatcaccatctgtattctcatccacatgttacactattatttctaaatttccaagaataatctgtaaaataactattttgcagtatttaatatctctattttcagtaacatgttattatattgtgttgagataaataacactgattaataaattggaatattatgaatgttttaattt

SEQ ID NO: 1574 - DNA, 277 bp, Homo sapiens
ctcatcaatgttcaattactggaccattctaaccctactcgctcctactcagtgtcaatgaaaagtctcattttcactgcatcatctggatgttcattgtctcaccactaaattgcacctttcttctcacaaactccttcaatttcctagtgttaaccaaaaccaggtttcttcaaaaccatatcaaagccttcttcaacggagaacattcctgctgtcatccgctgcccaacccagcatcctgctctgtgtttttgccatttactaatcatgggaa

SEQ ID NO: 1575 - DNA, 413 bp, Homo sapiens
tacttcacactaagggtggccgactacacaccacagcactctccttggcatgataacatctatgtccaatgttttcctagtcgccagttcttattaaggatatctattctttgatgccactttggtcagagaaaatcctccagagaagaatgtctattttctgttcctgaaaaattgcctataatccatggagaaacttcttgtctcgctggaatagaaaagcacatttggtgaaatgctttataaaagtgaaaggtgatcttcagctagcaaaatactgctttttagtataagaaactcatgaggaaaacattggacatagatgttatcatgccaaggagagtgctgtggtgtgtagtcggcgacccttagtgtgaagtactagtaagcctctacctgcacgacaacacata

SEQ ID NO: 1576 - DNA, 413 bp, Homo sapiens
gacagggcgttaggatgggaggtggcccagggaccccgcctcccccagggccaggtctgggggctcctggctgggatggtgttttattttcttctatttttaacttaaaaaatgacgatataagcactgcatgtggtggctcacacttggaatctcaacacttggggaggccaaggtagacaaattgcttgagcctaggagatcaataccagcctgggcaacattgcaagaccctgtctctacaaaaaatttaaaaattagcctggtgtggtgtcatgctcctgtggtcccagctactagggaggctgaggcatgagaatcgcttgggcccaggaggttgaggctgcagcgagctatgattgcaccgctgcaccccagcctgggtgacagagccagacagactgtgtctctta

SEQ ID NO: 1577 - DNA, 476 bp, Homo sapiens
tttcctgacctctgtatacatacagttctagatggctcatctggaaataacctgatcagctattagaaggactttcatatccagctgagccactgataaaaatgtccagcagcaaaaccaaccctaatatcctctacaaatttacaatcagactgggtcctctgccttccctcttaaaatctacatgggatttagagaaaagagtaggattagtggggcaaatttgaccaagatacctcacctctttgagcccctataattcttcccacctataaagtatgccgtcaatgggttaatccttgggaaattgtccatcacagtgcctggcatgcaataagtgatcaataaatgctaatatttttcagcctaaattaaaatgatggtgctattaggaaagaatgattgtttgggccacacatccactaccctgcctcttgtctggagcatgttggttcataattcagtaggtaatgagg

SEQ ID NO: 1578 - DNA, 579 bp, Homo sapiens
atgcacagcacaggtgagggaagtaggagaagccctgggtcaggccaggaacggtgttactagtcagggttctccacagaaacagaatcgataggatggatggacagacagactagaaagagagatgactcatggttgtgtgggctgcaaggcagggtagcaggctcagagacccagggaagaattgatgtcgcagtcctgggggcagaatcctttctcaggacacctcaggcttttctcttaaggccttcaattggttggatgaaatccacccacattatggaggggtaatatgctttactcaaagtctactgatttaaatgttaaccacgtctaaaataccttcacagcaacatctggaatagcatatgacgaaacaactggacaactatggcctgaaagttattggggattccttggtcagaggatggggtttaaggaatatggaagatatccctgggtccttctgagaattctccttggaagccaaaatggggggttaatgggggtttagggcagtttaaggaacaattggatagcctgggcaacacaggaagaatctgtcttaaaaaaaaaaga

SEQ ID NO: 1579 - DNA, 814 bp, Homo sapiens
atgcacagcacaggtgagggaagtaggagaagccctgggtcaggccaggaacggtgttactagtcagggttctccacagaaacagaatcgataggatggatggacagacagactagaaagagagatgactcatggttgtgtgggctgcaaggcagggtagcaggctcagagacccagggaagaattgatgtcgcagtcctgggggcagaatcctttctcaggacacctcaggcttttctcttaaggccttcaattggttggatgaaatccacccacattatggaggggtaatatgctttactcaaagtctactgatttaaatgttaaccacgtctaaaataccttcacagcaacatctggaatagcatatgacgaaacaactggacaactatggcctgaaagttattggggattccttggtcagaggatggggtttaaggaatatggaagatatccctgggtccttctgagaattctccttggaagccaaaatggggggttaatgggggtttagggcagtttaaggaacaattggatagcctgggctctttaaataagtatttttcgagcaaccttaatgaatggagtggtaggtagaatagaaagctatggcgaaatcccatctctactaaaaatacaaaaattaggtgtggtggcgcacacctgtaatcccagttactcaggaggctgaggcatgagaatcacttgaacccgggaggtagaggttgcaggttgcaggttgcagtgagccaagatttcatcactgcactccagcctgggcaacacaggaagaatctgtcttaaaaaaaaaaga

SEQ ID NO: 1580 - DNA, 362 bp, Homo sapiens
ttttttattttttgtagagacaaggtttccctatgttgtccaggctggtctccaactcctgggctcaagcaagcctcctgccttagcctcccaaagtgataggcatgagccaccgtgctcggcacaccgagttttattcagatgctatgtattaattatgcatatagtaaatttaactgtgctacataatttatagtttgttatcaagtggttcttataatgaaacattactaactttgggtcatctgtgttataggtgcctatgtttatacgcaaaaataaagtaaaatctaactaaaggctctactccagcttatggcaaacattttactgagctggtctttaatcattgttattattac

SEQ ID NO: 1581 - DNA, 1994 bp, Homo sapiens
gttgagctgtaccatggagcatcctcctgtgtcctgccaacccctgccattatagtcaccggagactcctttacctatccctatctgttagggttttcagatgtcctctcgctgggtttatatttgaaggtatagaatctgggaaagggtggggtgcaagctaaccaaatagggatgctagggttgggtggggaattgaggactcttctgtgcttttattgtagggctggggatcgaggatctgggcaaaaaaaatatgacatttccaaccagggacaaaatggaggcttgggcttagtgatgggtaaatggaagactggttgagtgggatgataatgggagaacttactgatgctcttttgggaaaaggtgctttaaagactcgatttgggagcctactggggcaaggcgactggggaggtgtacgtgttagtcaagtggaggtcaggtgggttatcttctgcctccttcactggcttcatgtgaacttgcctgtgacagaatatcttgccctagatgtcctcttccctcttgccatcgtgcaaaagcattcgatcttatgaccgtgagttcttatttgtggatgctaataactggggtaatctcagggagtactggggccatggctctttcccttgcttctctttctgctcactgctttgctttcaggtgcttagctgctcctttttatttctttgcaggactgggaaagcatgggaggaggattttgataagtttcttgttctctgcgtggtgatggggtggtctgagggccaagttaataagcctacctttggttattaccctggaaaattgagggttgatggtagggttatgattgtggcctgtgtatttgcaatttttctttgtcagtgtggctttctgtcatcttcctttttctccagtgagggttctgccactgtctcaatcccttggttcctgcaaaaaacagctaaatgtgctctcagggccagtggtgatgttctgtgttgcagccccagctcttgaaagtgacctggcccagatgagctctgcctgcttgtcatctttaggtcctgctgcccctgctgcctcagccctcaggctcctaactgctcaagccagaaggagctacaaagccaaatcatttgtcatttttctctggcagattgttttaaaatctccctcccctcttttattttaattatgccacctgtgttaatcctatagcctgcttctttgctttgtggattactgatttcaagttctataacttggggaaagttaggttgagtgaatgggaggacagacactgaatgtgtgttttggaaaaatggactctatcttcagattattcagcttctccacctatcacctctacaacttggccttcattggagaagttttagttggcttattcctggaacaagaccacctagaggcttttagccttgtcagcctgccctcttctgaggtttggaccttgttttaaattgtgtgcatggtgggcttgagactctcttgtaatggaggtaatgggactatcactgaggggttcagcctatccaggtaggctaccgttctagtcatacccatcacttaaattctgccacagtctgcacagacggttggtcctccaggcatattgtcctattaagccaaataggtggacatcatgggatggatgaggtcatcatgaaaacagatttactggatttatggacctagtatatactatgtaacagatggaaaactgaattttacaatctataggtacctttgaaaggtcataaagggtaaaagtctatagttttccagaaaataattcttaaaactgggttttatgtctagatttaaatcatgtatctgtctgtagtgcttcaaatgtggccaggtgtggtagctcacacctgtaattcccagcgctttgggaatttgaggcaagaggattgctagaggccaggattttgagaccagcttcggcaatacggtgagaccttgtctctaccaaaaga

SEQ ID NO: 1582 - DNA, 401 bp, Homo sapiens
ccttattaatattctgccaattgtcccaccgatgtcctttttctggtctaggatccaatccaggatcccatgtggcattctattgtcatgtctccttagtcttttaatcctcagtctttttttgtcttttatgactttggtactgttgagaagtacaggctagttattttgtagaatgtccctcaatttggatttgtctaatgcttcctcatgatcaaattcaggttacatattactgtggcaaaagtaccaaaaatacctgtatggtacctatcaacagggcacctgacacaacttgaaggggatctcagaagccgaatctgggcaatttgagcaagaacataaaaattgatagccatggatttcaccaatagaataagaatccatggttcttcctgaga

SEQ ID NO: 1583 - DNA, 597 bp, Homo sapiens
gcggaggagtcagctggcttctccagtgaggcggctgagagtgaagactccaagggcagaacaaacagcaaatgggagacaggcaggggcacgttccacagcacagacgtgggccagcccgctgggggcagtgtggagcaggcagtgccctcatccaggacctcagcattgaaggaagcgagggttctgtgaaccgtggtctcttagaggtcactgccctctgagggaagagctcacagtgagcaagatctgggtgggggctggcgggagggtgagcggaagctggctgaatgcagacacgatggccagagctccagcagccttctggggccatgaggatgaggcacccgccgggtgtggtggagtgggaggtgacaggctctttagggccccgccctccagagtcctttcttatgtgagaagggaatactgtgtgttaaagccactgttattttgggtgccaaccaattttaacctaaaattggttaaatatgcagccaaccaattttcatggaatcactagacaacccagaaccatcaaatgtttgaggaaaaccaatcactaccaaaaaggggcccccaaagtcagcaggtatc

SEQ ID NO: 1584 - DNA, 274 bp, Homo sapiens
tggaagatgaatctctggtttctcccggggatgatgtttgttttttctgtttggctgctatggccaaagtggatgcagtagccgcaggttccaaagggtcttgggcaggaggtcagggttctttggtgattctgtgctgatcctgaactttggggaaaaagtccctaatggcagtcagtactatccaggttgctgagaaaggaaagggaatgcctcaggccctggctggagcagcctctcagatacaaaggagaatagtctcgggtggtccgtg

SEQ ID NO: 1585 - DNA, 577 bp, Homo sapiens
cggactcttgaatattctttattatgatgttcattatgttactaaaaccagtagcatcaacaatgtgtcagaattcacatttattaccagattggtaataggattattaaagctacagagtgtcaggacaaggatttgtattaaagagtttttattaatatgataagctagttaataagttagccagttcaccccccaaccctaacaaatgaccatcgggtcagctcgcacactcagcctgctggcctccagcctaagctgaactgcttctatggcctctataggttagatatggctgaaccacactgggctgacagtcttggttgggaactcacacggaatgaaataaccagcaaaacgttctctgactgctttcttaccaccaaaaataaattggtagagattccagtatatcatcagtattgcagatgtcgagataaaaatcatcaggcccaattaagtggagaggcattggattaagtaattatgtgcataaaaaatacaaatacacatctcatgtttttcctggcacaccgtttacaatagagaaatattttgtaacattcaaaataaagaa

SEQ ID NO: 1586 - DNA, 1029 bp, Homo sapiens
cctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagacccgccagcagcagtggggcttggcctcacctagatcaatggagtggtccaaacttggtctggg

SEQ ID NO: 1587 - DNA, 363 bp, Homo sapiens
tttttggctaaaagaaactcccacacctatttaaactgatacagaagaaatcttcgatttgggaagtcaggagctgttagatgtatgactactgctatctgtgactcaagattttatcaggaatgggcaaccaaaagcaaaatgatgaaaacgggaagcaaaatttaatcctggtgtattttaactggtcttgtttgtggactttattgtaacttttctataacgctgaatgtagaaatgagtactaataaaacatatatctgtttcagacattggcctccccttttaatattccatttgaataaaaggcctctgctatctaaagcagtaacaatgtcagttgaagactatgacatcgtagta

SEQ ID NO: 1588 - DNA, 529 bp, Homo sapiens
tttttttttggagatatgaggtgttgctatgttgcccaggataaaatgccattttttttttttttgagagtctcctctcactctgtcacccaagctggagtgtagctgcacaatctcggctcattgcaacctctgcctcccgagttcaagtgattcttgtgccttagcctcctgagtagctgggacaacagacacatgccaccatgcccagataattttttgtatttttagtagagacagggtttcgccatgttagccagactggtctcgaactcctggcctcaagtgatccacccatcttaatgccattttaaaaggactcacagaagtggccattgagatattccttaaaagatcacagggttttaacaggaagaaaaatgtggtagggggtgagaagagtgaaaagaatttcaggcataaagaacagttgaagtaatggttcatgggaagacagtgtgagaggtgcagaaacaaggtaagaatttgttgggttggatgatgagggagatgaggttacaggagatac

SEQ ID NO: 1589 - DNA, 337 bp, Homo sapiens
tgaggcggagtctcactctgtcacccagactggaatgcagtggcacgatctcagcttactgcaacctctgcctcctgggttcaagtgattctcctgcttcagcctcccaagtagctgggattacaggcacgcgccaccatacctggctaattttttgtatttttagtagagacggggttttgccatgttggccaggctggtctcaaacccctgagctcaggagatccacccgcctcagcctcccaaagtgctaggattaacagacttgagccaccacgcaggccattacctcccttattcttcattgcaatcctcagaggaagcacatagtagggac

SEQ ID NO: 1590 - DNA, 390 bp, Homo sapiens
tatgtgaagggacacattaagatcaaatctagaggactctcttgaactgggaaccatagccaccagttgtctatgaaaaaaaatgtatcaaacaaattccattcataagtactataagaagaaaacagaggttgggaatcaaaactttcattttatatttgcccctggactaaaatcttgggtcagactgacctcattatgaaaattctctcctcaaagaacttttataagaaaaaaaatccctagccgggcatagtggcgggcacctgtagtcccagctactcgggaggctgaggcagaagaatggcgtgaacccaggagacggagtttgcagtgagccaagatcgtgccactgcactccagcctgggtgacagagcgagacaacatca

SEQ ID NO: 1591 - DNA, 591 bp, Homo sapiens
gtcagctgggattttgatagaactgcattgaatttgtagaccaattttgatatactgccatcttaataatattgtcttctgatccataaaaatagaacatctttttatttatttagttctttgatttctgtaaaaatattgtcggtttttttgtagtataaatttcgtacttcttttattacatttatttctaagtattttatttttccctagctttattgaagcataattgacaaacaagaattatatacattcaagttgtacaacatgatttttaaaatgcatatatattgtgaaatgattaccacaatcaagctaattaacatatctatgacacatagttaatatttttgtgtgtggtgagaatacttaagatctattctcttagtaaatttcaagtataccaatagttgccatcctgttgtaagcccaaatcactttggcttagtgattttggggacctgagattatttttcctttcacactgtacattaggtttccagaacttattcaccctataactgcaagttggtaaacttttaccaacatctccccatttcccctaaccatgactcctagtaacccctaaaa

SEQ ID NO: 1592 - DNA, 559 bp, Homo sapiens
ctccacacctccctgcaagctaaggaagccggctccggccttgggcagcccagaaaggggctcccacagtgcagcggcgggctgaagggctcctcaagcgcggccagagtgggcgccaaggcggaggaggcgctgacatcgagcgggggctgtgagggctgccagcatgctgtcacctctcagtcccactagatcccaagaggcagcagaggcagcttctgaaaaataaaataaattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattattttctgaaggcaaaaatgcatgtttgttagaatggaaacagaaaaacattaaaaagttcattccttaa

SEQ ID NO: 1593 - DNA, 2133 bp, Homo sapiens
tcactaccctgtcacctttggaaagttaacttttagaattctcagtgtctttgtctgtaaaatattgtccctcataaaattgtttggaggtgcctccctcttacagttgttaggaagttcaagtaggccagtgttgccaaggagttcagcaaaatacctgctgttattattatctaatattgtgatttttttaacagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacgcacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcattatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagcttcttatatattctactggaataactgcatcttccactcagtcactacaaaaaagcatagtttcagtttgcatgaatttttttttttttcttcaatggttgtgcagataaggatccatttctgggatagaattgtattttttaagtcatttttttttcttgaaatggatatgtacaaataaaataaatggaagacaggataaaaaaattt

SEQ ID NO: 1594 - DNA, 1098 bp, Homo sapiens
gtccgcccacgcgtccggcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattattttctgaaggcaaaaatgcatgtttgttagaatggaaacagaaaaacattaaaaagttcattccttaa

SEQ ID NO: 1595 - DNA, 441 bp, Homo sapiens
gaccttgaagggaaccagaaggccaagaaaggaaaaaaccagaggccctgggcctttcccagaacatcagcagggtgaggtttctgactgtgttgtgctcccactcccatctccagattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattattttctgaaggcaaaaatgcatgtttgttagaatggaaacagaaaaacattaaaaagttcattccttaa

SEQ ID NO: 1596 - DNA, 548 bp, Homo sapiens
tcactaccctgtcacctttggaaagttaacttttagaattctcagtgtctttgtctgtaaaatattgtccctcataaaattgtttggaggtgcctccctcttacagttgttaggaagttcaagtaggccagtgttgccaaggagttcagcaaaatacctgctgttattattatctaatattgtgatttttttaacagggtgatgaccagttaaatgtatttggagaggacactatgggaggtttcatggaagatttgagaaagtgtaaaattattttcataattgtctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattattttctgaaggcaaaaatgcatgtttgttagaatggaaacagaaaaacattaaaaagttcattccttaa

SEQ ID NO: 1597 - DNA, 1075 bp, Homo sapiens
tgcgttcgccacgctgtcctccctcctccgctccctgcgccccacccctggcggccgcgctgcctggcagcccgggaagccgcggcacagctgctcggcgcctgcagctccggctcgggggctgggaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgagagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaacagaagatccacagtaccagcagcaataggaaatggagtcttattgccaagataattacaactggagaattggccccacaggaaacaacaattacagagataaaacaaaaattgatgcaaatacctgatgaagagggcattgttattgatggatttccaagagatgttgcccaggctctatcttttgaggaccaagtaagaatatctccttatattttaaatgaactactttttgcttaaaattttgggaataaaaacaaaaagacttcttgg

SEQ ID NO: 1598 - DNA, 1306 bp, Homo sapiens
agtttcagtcttccagcagggttctgaaagcagcctgctcccatcgcgcccctcggatgtggacacccagggtgggctgcagaccgcggccgggccgcactctctgggggcgagggccaggtcaggtggctgcactgtcgcccagcagcgagtaaagactcgaaactgagggagccagagccctagtcactctgctggtcgagggtcggaacccctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctggagatagcgggtcggggagggagctgcgaggggggcggactcctgttgctcagtcttcagaccgcagcacagcatcatctgcaccgggacccgggaatggggggacacttggagactgagagagaggaggctcgaggaatgaaccttgagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaacagaagatccacagtaccagcagcaataggaaatggagtcttattgccaagataattacaactggagaattggccccacaggaaacaacaattacagagataaaacaaaaattgatgcaaatacctgatgaagagggcattgttattgatggatttccaagagatgttgcccaggctctatcttttgaggaccaagtaagaatatctccttatattttaaatgaactactttttgcttaaaattttgggaataaaaacaaaaagacttcttgg

SEQ ID NO: 1599 - DNA, 1036 bp, Homo sapiens
agtttcagtcttccagcagggttctgaaagcagcctgctcccatcgcgcccctcggatgtggacacccagggtgggctgcagaccgcggccgggccgcactctctgggggcgagggccaggtcaggtggctgcactgtcgcccagcagcgagtaaagactcgaaactgagggagccagagccctagtcactctgctggtcgagggtcggaacccctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctggagatagcgggtcggggagggagctgcgaggggggcggactcctgttgctcagtcttcagaccgcagcacagcatcatctgcaccgggacccgggaatggggggacacttggagactgagagagaggaggctcgaggaatgaaccttggtctgttctaagccacaacccctgtctcaggtcgtttggcttcctttccttctctttgtatttgaatttaaaaacattcctgaatctcaagtgcttttgcttgaagtaggggggaggaggagaaaagaatagaagcaagccaggcttcctaagcgagctctgaaaggagaaatccattcactgcaaacctcgttccccatttctgaaaacggatagactgatatcgtaaactaaaggtcatgagggtttttccccccggtttgggggatttgttctgttaaaaggaattttaaagcaccacttgagaaaataattttgcctcagtttccctaaactatctttaaaatgggttgccataattacaggtcttcttttctctcacctctataagccaccgttttcaggtcatctgaagtcaagatttccaggtaaaccactcactgaactc

SEQ ID NO: 1600 - DNA, 327 bp, Homo sapiens
caactgactagaattagcctacaagaagaagttttctttcaccttagtgagataatttattatggccataagtaactgaaatgtagcatttggggatgaaaagcacagttaccagccaaagactccctgggggatggcggggggaatatgggcctgtgcatcagaaagccccaggcacactttcatcaacttcgataaatgcagagggaacaccagaggacgtttttcttcaactctgcacagctattgactctattattttctgaaggcaaaaatgcatgtttgttagaatggaaacagaaaaacattaaaaagttcattccttaa

SEQ ID NO: 1601 - DNA, 225 bp, Homo sapiens
tcagcgtgtgattactcatgtctcctgactgaccaaggtccacatttgtcaaggtcaagagttgggcagaagctctggtttctctttaagagataaatgcagagggaacaccagaggacgtttttcttcaactctgcacagctattgactctattattttctgaaggcaaaaatgcatgtttgttagaatggaaacagaaaaacattaaaaagttcattccttaa

SEQ ID NO: 1602 - DNA, 2340 bp, Homo sapiens
gtccgcccacgcgtccggcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacgcacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcattatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagcttcttatatattctactggaataactgcatcttccactcagtcactacaaaaaagcatagtttcagtttgcatgaatttttttttttttcttcaatggttgtgcagataaggatccatttctgggatagaattgtattttttaagtcatttttttttcttgaaatggatatgtacaaataaaataaatggaagacaggataaaaaaattt

SEQ ID NO: 1603 - DNA, 1710 bp, Homo sapiens
tcctgaccactctcgctttgctccagggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacgcacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcattatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagcttcttatatattctactggaataactgcatcttccactcagtcactacaaaaaagcatagtttcagtttgcatgaatttttttttttttcttcaatggttgtgcagataaggatccatttctgggatagaattgtattttttaagtcatttttttttcttgaaatggatatgtacaaataaaataaatggaagacaggataaaaaaattt

SEQ ID NO: 1604 - DNA, 1744 bp, Homo sapiens
tgcgttcgccacgctgtcctccctcctccgctccctgcgccccacccctggcggccgcgctgcctggcagcccgggaagccgcggcacagctgctcggcgcctgcagctccggctcgggggctggaaccgaagcgggggcggcgggagtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacgcacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcattatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagcttcttatatattctactggaataactgcatcttccactcagtcactacaaaaaagcatagtttcagtttgcatgaatttttttttttttcttcaatggttgtgcagataaggatccatttctgggatagaattgtattttttaagtcatttttttttcttgaaatggatatgtacaaataaaataaatggaagacaggataaaaaaattt

SEQ ID NO: 1605 - DNA, 1801 bp, Homo sapiens
ctccacacctccctgcaagctaaggaagccggctccggccttgggcagcccagaaaggggctcccacagtgcagcggcgggctgaagggctcctcaagcgcggccagagtgggcgccaaggcggaggaggcgctgacatcgagcgggggctgtgagggctgccagcatgctgtcacctctcagtcccactagatcccaagaggcagcagaggcagcttctgaaaaataaaataaattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacgcacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcattatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagcttcttatatattctactggaataactgcatcttccactcagtcactacaaaaaagcatagtttcagtttgcatgaatttttttttttttcttcaatggttgtgcagataaggatccatttctgggatagaattgtattttttaagtcatttttttttcttgaaatggatatgtacaaataaaataaatggaagacaggataaaaaaattt

SEQ ID NO: 1606 - DNA, 1532 bp, Homo sapiens
gtccgcccacgcgtccggcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacgcacactttgtatcatgcaggccacactcagagctagtcagtacatgaacagtggtgcggtgccagtctgtgtccgttgtgatcacaggccttgctagaccctgatcatctggttctcctctcgatgggtgtcgttgatcttagccggaaaacagctggaagatggtcgtaccctgtctgactacaacatccagaaagagtccaccttgcacctggtgctccgtcttagaggtgggatgcaaatcttcg

SEQ ID NO: 1607 - DNA, 1689 bp, Homo sapiens
gtccgcccacgcgtccggcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattattttctgaaggcaaaaatgcatgtttgttagaaacttggaatactgtcattatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagcttcttatatattctactggaataactgcatcttccactcagtcactacaaaaaagcatagtttcagtttgcatgaatttttttttttttcttcaatggttgtgcagataaggatccatttctgggatagaattgtattttttaagtcatttttttttcttgaaatggatatgtacaaataaaataaatggaagacaggataaaaaaattt

SEQ ID NO: 1608 - DNA, 1122 bp, Homo sapiens
tgcgttcgccacgctgtcctccctcctccgctccctgcgccccacccctggcggccgcgctgcctggcagcccgggaagccgcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgagagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaacagaagatccacagtaccagcagcaataggaaatggagtcttattgccaagataattacaactggagaattggccccacaggaaacaacaattacagagataaaacaaaaattgatgcaaatacctgatgaagagggcattgttattgatggatttccaagagatgttgcccaggctctatcttttgaggaccaagtaagaatatctccttatattttaaatgaactactttttgcttaaaattttgggaataaaaacaaaaagacttcttgg

SEQ ID NO: 1609 - DNA, 1155 bp, Homo sapiens
gtccgcccacgcgtccggcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattattttctgaaggcaaaaatgcatgtttgttagaatggaaacagaaaaacattaaaaagttcattccttaagaaaaaaaaaacagaacacagtgtaaagaaaaaaaaacttatgatctcgtttgtgct

SEQ ID NO: 1610 - DNA, 1050 bp, Homo sapiens
tgcgttcgccacgctgtcctccctcctccgctccctgcgccccacccctggcggccgcgctgcctggcagcccgggaagccgcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgagagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaacagaagatccacagtaccagcagcaataggaaatggagtcttattgccaagataattacaactggagaattggccccacaggaaacaacaattacagagataaaacaaaaattgatgcaaatacctgatgaagagggcattgttattgatggatttccaagagatgttgcccaggctctatcttttgaggaccaagtaagaatatctccttatattttaaatgaactactttttgcttaaaattttgggaataaaaacaaaaagacttcttgg

SEQ ID NO: 1611 - DNA, 538 bp, Homo sapiens
gtccgcccacgcgtccggcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcaggtaattaaaatctgaaaatagttctctatttaaatgtttttaagttgaacctttgtaaatgttttatgaaaatttgaattataaaaactcattttgtgaaatatatacagataactaataacatattacatgat

SEQ ID NO: 1612 - DNA, 507 bp, Homo sapiens
gtccgcccacgcgtccggcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcacgccggtcctcccatttatgctgaaaacccagttgaaagaatcatcaaaagact

SEQ ID NO: 1613 - DNA, 475 bp, Homo sapiens
  misc_feature (453)..(453): n is a, c, g, or t
agaagatcaaggatagaaaaataaatgatggacaaagaaaactgtaaaaatatagggaaatttaaacaaacattgcttttataaaacaagaatggcaatgtctgatttacgcacagtaaacggtacggcaagcgtggtgggaggaactgactgaattaaagcattttttagggcctttaattgtttcagaagagaatggaaattgactaactttaaactcttaagtattcacattcaaagcttgagagtaaactaagaaaataaaagttgaatgtctatctttcgaatgcatagtttagaaaaatggaatgaggccgggcgcggtggctcaagcctgtaatcccagcactttgggctgcaaaacacatttattatctcacagtttctgtgtgtcagagattcagaagcagctggggctagggtgggtcctagcttcagggatctcttgttganggttgcccatcccagtttggtt

SEQ ID NO: 1614 - DNA, 312 bp, Homo sapiens
ctaccctatcaagagggtattgaagcctcaagcatctgggccttctttgaatctcacattttcaggactgtcatgtttacatatacgtaaataaatttttaagcctttttctcctattaatctgtctactgtcagtcatttcagcaaaacatcagagaagacagaaagaagctttccttctgtcccatgacttcatgccaggtaataagcatatgctatctcatttaaccctctcacaggctctttggattgcccctattgtacaattggtacaattgtaggaaaagatgtgaaggtttttgaaatgggaaa

SEQ ID NO: 1615 - DNA, 471 bp, Homo sapiens
acggaatagtctgtacatgacaggttttgggtatcagccccacaggataaaactaaatgttcctccttccacttttctcagtgagaccaacatcatggctcagctcctttgaagatgtttagatttactctgctccaggaccctcgctatgcctctgatcacagttgccatttcataggtgtgtgtctcatgccaggggaacctggaaacacaccagtgactacgtgcaggtgctttgctacctctgtgaacagggcgagggtgtgcagtggtgcaaggcctttcatgaggggcccagccaagggggttagtcgagggcagaaactggccattgactgagttgccaggctctgtgccctgaggtccctgggcagaaaaggccccatttccaatttgcaccaagctgccatgtgggttggcagaggactcgtctttgcttgtgttgtagtgcaaagactatgggttttgtag

SEQ ID NO: 1616 - DNA, 796 bp, Homo sapiens
  misc_feature (10)..(10): n is a, c, g, or t
  misc_feature (12)..(12): n is a, c, g, or t
cattatggcngngggacatgggttggaagatggcgtctcccacagacgggacagatctggaagcatctttgctaagttttgaaaaacttgaccgtgcctcaccagatctttggccagaacaattaccaggtgttgctgaatttgcagcttccttcaaaagtcctattactagttctccacccaaatggatggctgagatagaacgtgatgacatcgacatgttgaaagaactggggagtctcaccacggctaatttgatggagaaggttcgaggcctacagaacctagcctatcagctggggctggatgagtagatggggtctccctgtgttgcccaggctggccacatcctcctaggctcaagcaatcctcccgcctcagcctcccaaagcactgggattataggtgtgagccaccatgccctgcccctgggtctccctctgtcacccaggctggagtgcaatggtgtgatcttggctcactgcaacccctacctcccgggctcaagcaagtcccccacctcagcttcccaagtagctgggactacaggtgtgagccacagcgcccggccagaaatgcttttttaatataactgagattagtgtgtgtgtgtgtgtgtgtgtgtgtgtgtgtgtgtgtagttataacgttgtgctttaaaaaattttattctatcttaagcattttcctgtgtcattaaagagttctaccagctgaagatttggaataggaaagatacacacctttagggaggcattggtgcacaggatagagtaggatggtagagagaggaggc

SEQ ID NO: 1617 - DNA, 2927 bp, Homo sapiens
  misc_feature (10)..(10): n is a, c, g, or t
  misc_feature (12)..(12): n is a, c, g, or t
cattatggcngngggacatgggttggaagatggcgtctcccacagacgggacagatctggaagcatctttgctaagttttgaaaaacttgaccgtgcctcaccagatctttggccagaacaattaccaggtgttgctgaatttgcagcttccttcaaaagtcctattactagttctccacccaaatggatggctgagatagaacgtgatgacatcgacatgttgaaagaactggggagtctcaccacggctaatttgatggagaaggttcgaggcctacagaacctagcctatcagctggggctggatgagtccagagagatgacacgggggaaattcctcaatattctagagaagcccaagaagtagcagctgcttgcggacaggatgtcctggggtccgaaaccaagctcccttcccggtgcacctctaacaatgcacacctcactgcttgcttgggagaggccagagggtgtacctccaggactgccctctcccctgctcctggcactctacacgtctgaggacattcagcagcaagagaagaatctgctctacccaaggatcattgcagttactcaatcaactttcagacttgaaccttcttagcctcggatattggtaacagctgagggcatatcattcttaaaggtcgaagtcctgctttctcatttctggaagtgattcaggagccccaggatcttacggttgatttgactcagtcatggcagtcagttgtgacatgttgattggatgggttcttttgaattgttcttgatctcttagaaagtgtttacgatgtgaggagaccagagaccaagtagattctggaccagaccatgcagcctgacctgtgaactctccagtatatactaagttcccagaatccccagctgaagaaaccagaatcttctcgaaatgtatatctgttttttaaaacttctatacctcttatgatagtcccatttgcttttcattccttacttcccagccccaccttctagttctgacttcgggcagagggatccctgagtccctcctggaattagcttgtatagtgaaaggcccatccaaggttgtctaaagaccaatgtgaaggtgacagaaaggacttttgagttctaattaatctgttacagcttcaagcaagaaagtcagtatagcctgaaagacaagagaaacgggatggtttataggagttcccatttggttgaaagctagaagccctaattgaccttaaagtaacatgctatgggatggtgggattgtcccctctgacagcacatatgaaatagttcatctatataatagaaacgcacacacacgaaagagaatcttctgacttaaatacaactttcatggagttcttcaccacttatctgtctctgttaaaatctgaaaatctagcccatggctaaaatctattatatgtgttctccatatttcttgtataagccagtccccagcatctgatgttttgagaagtgcatggagtttcctaaactttgcacagaagaatatcctggggccgggcatggtggctcacgcctgtaatcccagcactttgggaggccgaggcaggtggatcataggtcaaaagatcgagaccatcctggccaatatggtgaaaccctgtctctactaaaatacaaaaattagctgggcatgatggtgcatgcctatagtcccagctacttgggggcctgaggcacgagaatcgcttgaattcgggaggtggaggttgcagtgagccgaaattatgcccctgcactccagcctgggcaacagagtgagactctgtctcagaaaaaaaaaaaaaaaaaagaatatccctgtggcaatagtctgatggtgtttggacacaagaaaagttatggttttgagtcgtgagtgtttgctagggcatggcactcttcagtttaacagctgatccattaaaccttttctgacatttgtgccttgttctcatgctagaattaatgctggatttttctctcatttgaccatcaatgtagttttacttattgaaaggaaaaaagacttaacacaagataggaaagatgagtatgagaagtaaaacattctgctggggtgctacatagaaggttaggttgtaggggctttgattttaatttaaacttattatcgattgatatttctgtatctcactaaatgcggttgaagagtgtgtgtgtgtgtgtgtgcgcgcgcgcgcatgtggccaaaaaatagtgccataatgtcaaattcttcctttgctctgtttttgagagttgatgacatcaggcacttttcagtgtttggggaaattgattgggatacctcccccaaaccaactcaagtctgtaactggaagccaggtggttggttttctggtccgctttgtcctctttcttttaccgtcatcctattcaccagcacttaatgtaagtagatgttttagaattgcaatatttattggtttagtatttgtcatccttagaaatgttaatgatgtatttttatattgataatataaatttatgtacagtatgtgtgtatatgtatttcaggatgttatagtattgtactttgtatgtgatggtttttgtgtcttcataataaatatgtcccttttaaaaaaaaacacaaccgcccgccaccacacccccccccccccaacacaacccttaagcaacggacaccccaagccaaaactggaagaaggcaaacagcccgcagcaccgcacgccccgcgcgcacaaaagcgaataataccctagagagaggcggccgtacaccaagcgcaggcacaacccgcaccccctctggaagacagccccaccaggacataagagcagaggggcccacacgagagcaacaacgatacagcgcaccaccggtgtgagacagccacccaatcgcgacgaacaagggtagcaacaccgg

SEQ ID NO: 1618 - DNA, 2617 bp, Homo sapiens
  misc_feature (10)..(10): n is a, c, g, or t
  misc_feature (12)..(12): n is a, c, g, or t
cattatggcngngggacatgggttggaagatggcgtctcccacagacgggacagatctggaagcatctttgctaagttttgaaaaacttgaccgtgcctcaccagatctttggccagaacaattaccaggtgttgctgaatttgcagcttccttcaaaagtcctattactagttctccacccaaatggatggctgagatagaacgtgatgacatcgacatgttgaaagaactggggagtctcaccacggctaatttgatggagaaggttcgaggcctacagaacctagcctatcagctggggctggatgagtccagagagatgacacgggggaaattcctcaatattctagagaagcccaagaagtagcagctgcttgcggacaggatgtcctggggtccgaaaccaagctcccttcccggtgcacctctaacaatgcacacctcactgcttgcttgggagaggccagagggtgtacctccaggactgccctctcccctgctcctggcactctacacgtctgaggacattcagcagcaagagaagaatctgctctacccaaggatcattgcagttactcaatcaactttcagacttgaaccttcttagcctcggatattggtaacagctgagggcatatcattcttaaaggtcgaagtcctgctttctcatttctggaagtgattcaggagccccaggatcttacggttgatttgactcagtcatggcagtcagttgtgacatgttgattggatgggttcttttgaattgttcttgatctcttagaaagtgtttacgatgtgaggagaccagagaccaagtagattctggaccagaccatgcagcctgacctgtgaactctccagtatatactaagttcccagaatccccagctgaagaaaccagaatcttctcgaaatgtatatctgttttttaaaacttctatacctcttatgatagtcccatttgcttttcattccttacttcccagccccaccttctagttctgacttcgggcagagggatccctgagtccctcctggaattagcttgtatagtgaaaggcccatccaaggttgtctaaagaccaatgtgaaggtgacagaaaggacttttgagttctaattaatctgttacagcttcaagcaagaaagtcagtatagcctgaaagacaagagaaacgggatggtttataggagttcccatttggttgaaagctagaagccctaattgaccttaaagtaacatgctatgggatggtgggattgtcccctctgacagcacatatgaaatagttcatctatataatagaaacgcacacacacgaaagagaatcttctgacttaaatacaactttcatggagttcttcaccacttatctgtctctgttaaaatctgaaaatctagcccatggctaaaatctattatatgtgttctccatatttcttgtataagccagtccccagcatctgatgttttgagaagtgcatggagtttcctaaactttgcacagaagaatatcctggggccgggcatggtggctcacgcctgtaatcccagcactttgggaggccgaggcaggtggatcataggtcaaaagatcgagaccatcctggccaatatggtgaaaccctgtctctactaaaatacaaaaattagctgggcatgatggtgcatgcctatagtcccagctacttgggggcctgaggcacgagaatcgcttgaattcgggaggtggaggttgcagtgagccgaaattatgcccctgcactccagcctgggcaacagagtgagactctgtctcagaaaaaaaaaaaaaaaaaagaatatccctgtggcaatagtctgatggtgtttggacacaagaaaagttatggttttgagtcgtgagtgtttgctagggcatggcactcttcagtttaacagctgatccattaaaccttttctgacatttgtgccttgttctcatgctagaattaatgctggatttttctctcatttgaccatcaatgtagttttacttattgaaaggaaaaaagacttaacacaagataggaaagatgagtatgagaagtaaaacattctgctggggtgctacatagaaggttaggttgtaggggctttgattttaatttaaacttattatcgattgatatttctgtatctcactaaatgcggttgaagagtgtgtgtgtgtgtgtgtgcgcgcgcgcgcatgtggccaaaaaatagtgccataatgtcaaattcttcctttgctctgtttttgagagttgatgacatcaggcacttttcagtgtttggggaaattgattgggatacctcccccaaaccaactcaagtctgtaactggaagccaggtggttggttttctggtccgctttgtcctctttcttttaccgtcatcctattcaccagcacttaatgtaagtagatgttttagaattgcaatatttattggtttagtatttgtcatccttagaaatgttaatgatgtatttttatattgataatataaatttatgtacagtatgtgtgtatatgtatttcaggatgttatagtattgtactttgtatgtgatggtttttgtgtcttcataataaatatgtccctttta

SEQ ID NO: 1619 - DNA, 2647 bp, Homo sapiens
  misc_feature (10)..(10): n is a, c, g, or t
  misc_feature (12)..(12): n is a, c, g, or t
cattatggcngngggacatgggttggaagatggcgtctcccacagacgggacagatctggaagcatctttgctaagttttgaaaaacttgaccgtgcctcaccagatctttggccagaacaattaccaggtgttgctgaatttgcagcttccttcaaaagtcctattactagttctccacccaaatggatggctgagatagaacgtgatgacatcgacatgttgaaagaactggggagtctcaccacggctaatttgatggagaaggttcgaggcctacagaacctagcctatcagctggggctggatgagtccagagagatgacacgggggaaattcctcaatattctagagaagcccaagaagtagcagctgcttgcggacaggatgtcctggggtccgaaaccaagctcccttcccggtgcacctctaacaatgcacacctcactgcttgcttgggagaggccagagggtgtacctccaggactgccctctcccctgctcctggcactctacacgtctgaggacattcagcagcaagagaagaatctgctctacccaaggatcattgcagttactcaatcaactttcagacttgaaccttcttagcctcggatattggtaacagctgagggcatatcattcttaaaggtcgaagtcctgctttctcatttctggaagtgattcaggagccccaggatcttacggttgatttgactcagtcatggcagtcagttgtgacatgttgattggatgggttcttttgaattgttcttgatctcttagaaagtgtttacgatgtgaggagaccagagaccaagtagattctggaccagaccatgcagcctgacctgtgaactctccagtatatactaagttcccagaatccccagctgaagaaaccagaatcttctcgaaatgtatatctgttttttaaaacttctatacctcttatgatagtcccatttgcttttcattccttacttcccagccccaccttctagttctgacttcgggcagagggatccctgagtccctcctggaattagcttgtatagtgaaaggcccatccaaggttgtctaaagaccaatgtgaaggtgacagaaaggacttttgagttctaattaatctgttacagcttcaagcaagaaagtcagtatagcctgaaagacaagagaaacgggatggtttataggagttcccatttggttgaaagctagaagccctaattgaccttaaagtaacatgctatgggatggtgggattgtcccctctgacacactttgggaggccgaggcaggtggatcataggtcaaaagatcgagaccatcctggccaatatggtgaaaccctgtctctactaaaatacaaaaattagctgggcatgatggtgcatgcctatagtcccagctacttgggggcctgaggcacgagaatcgcttgaattcgggaggtggaggttgcagtgagccgaaattatgcccctgcactccagcctgggcaacagagtgagactctgtctcagaaaaaaaaaaaaaaaaaagaatatccctgtggcaatagtctgatggtgtttggacacaagaaaagttatggttttgagtcgtgagtgtttgctagggcatggcactcttcagtttaacagctgatccattaaaccttttctgacatttgtgccttgttctcatgctagaattaatgctggatttttctctcatttgaccatcaatgtagttttacttattgaaaggaaaaaagacttaacacaagataggaaagatgagtatgagaagtaaaacattctgctggggtgctacatagaaggttaggttgtaggggctttgattttaatttaaacttattatcgattgatatttctgtatctcactaaatgcggttgaagagtgtgtgtgtgtgtgtgtgcgcgcgcgcgcatgtggccaaaaaatagtgccataatgtcaaattcttcctttgctctgtttttgagagttgatgacatcaggcacttttcagtgtttggggaaattgattgggatacctcccccaaaccaactcaagtctgtaactggaagccaggtggttggttttctggtccgctttgtcctctttcttttaccgtcatcctattcaccagcacttaatgtaagtagatgttttagaattgcaatatttattggtttagtatttgtcatccttagaaatgttaatgatgtatttttatattgataatataaatttatgtacagtatgtgtgtatatgtatttcaggatgttatagtattgtactttgtatgtgatggtttttgtgtcttcataataaatatgtcccttttaaaaaaaaacacaaccgcccgccaccacacccccccccccccaacacaacccttaagcaacggacaccccaagccaaaactggaagaaggcaaacagcccgcagcaccgcacgccccgcgcgcacaaaagcgaataataccctagagagaggcggccgtacaccaagcgcaggcacaacccgcaccccctctggaagacagccccaccaggacataagagcagaggggcccacacgagagcaacaacgatacagcgcaccaccggtgtgagacagccacccaatcgcgacgaacaagggtagcaacaccgg

SEQ ID NO: 1620 - DNA, 2860 bp, Homo sapiens
  misc_feature (10)..(10): n is a, c, g, or t
  misc_feature (12)..(12): n is a, c, g, or t
cattatggcngngggacatgggttggaagatggcgtctcccacagacgggacagatctggaagcatctttgctaagttttgaaaaacttgaccgtgcctcaccagatctttggccagaacaattaccaggtgttgctgaatttgcagcttccttcaaaagtaactggggagtctcaccacggctaatttgatggagaaggttcgaggcctacagaacctagcctatcagctggggctggatgagtccagagagatgacacgggggaaattcctcaatattctagagaagcccaagaagtagcagctgcttgcggacaggatgtcctggggtccgaaaccaagctcccttcccggtgcacctctaacaatgcacacctcactgcttgcttgggagaggccagagggtgtacctccaggactgccctctcccctgctcctggcactctacacgtctgaggacattcagcagcaagagaagaatctgctctacccaaggatcattgcagttactcaatcaactttcagacttgaaccttcttagcctcggatattggtaacagctgagggcatatcattcttaaaggtcgaagtcctgctttctcatttctggaagtgattcaggagccccaggatcttacggttgatttgactcagtcatggcagtcagttgtgacatgttgattggatgggttcttttgaattgttcttgatctcttagaaagtgtttacgatgtgaggagaccagagaccaagtagattctggaccagaccatgcagcctgacctgtgaactctccagtatatactaagttcccagaatccccagctgaagaaaccagaatcttctcgaaatgtatatctgttttttaaaacttctatacctcttatgatagtcccatttgcttttcattccttacttcccagccccaccttctagttctgacttcgggcagagggatccctgagtccctcctggaattagcttgtatagtgaaaggcccatccaaggttgtctaaagaccaatgtgaaggtgacagaaaggacttttgagttctaattaatctgttacagcttcaagcaagaaagtcagtatagcctgaaagacaagagaaacgggatggtttataggagttcccatttggttgaaagctagaagccctaattgaccttaaagtaacatgctatgggatggtgggattgtcccctctgacagcacatatgaaatagttcatctatataatagaaacgcacacacacgaaagagaatcttctgacttaaatacaactttcatggagttcttcaccacttatctgtctctgttaaaatctgaaaatctagcccatggctaaaatctattatatgtgttctccatatttcttgtataagccagtccccagcatctgatgttttgagaagtgcatggagtttcctaaactttgcacagaagaatatcctggggccgggcatggtggctcacgcctgtaatcccagcactttgggaggccgaggcaggtggatcataggtcaaaagatcgagaccatcctggccaatatggtgaaaccctgtctctactaaaatacaaaaattagctgggcatgatggtgcatgcctatagtcccagctacttgggggcctgaggcacgagaatcgcttgaattcgggaggtggaggttgcagtgagccgaaattatgcccctgcactccagcctgggcaacagagtgagactctgtctcagaaaaaaaaaaaaaaaaaagaatatccctgtggcaatagtctgatggtgtttggacacaagaaaagttatggttttgagtcgtgagtgtttgctagggcatggcactcttcagtttaacagctgatccattaaaccttttctgacatttgtgccttgttctcatgctagaattaatgctggatttttctctcatttgaccatcaatgtagttttacttattgaaaggaaaaaagacttaacacaagataggaaagatgagtatgagaagtaaaacattctgctggggtgctacatagaaggttaggttgtaggggctttgattttaatttaaacttattatcgattgatatttctgtatctcactaaatgcggttgaagagtgtgtgtgtgtgtgtgtgcgcgcgcgcgcatgtggccaaaaaatagtgccataatgtcaaattcttcctttgctctgtttttgagagttgatgacatcaggcacttttcagtgtttggggaaattgattgggatacctcccccaaaccaactcaagtctgtaactggaagccaggtggttggttttctggtccgctttgtcctctttcttttaccgtcatcctattcaccagcacttaatgtaagtagatgttttagaattgcaatatttattggtttagtatttgtcatccttagaaatgttaatgatgtatttttatattgataatataaatttatgtacagtatgtgtgtatatgtatttcaggatgttatagtattgtactttgtatgtgatggtttttgtgtcttcataataaatatgtcccttttaaaaaaaaacacaaccgcccgccaccacacccccccccccccaacacaacccttaagcaacggacaccccaagccaaaactggaagaaggcaaacagcccgcagcaccgcacgccccgcgcgcacaaaagcgaataataccctagagagaggcggccgtacaccaagcgcaggcacaacccgcaccccctctggaagacagccccaccaggacataagagcagaggggcccacacgagagcaacaacgatacagcgcaccaccggtgtgagacagccacccaatcgcgacgaacaagggtagcaacaccgg

SEQ ID NO: 1621 - DNA, 1455 bp, Homo sapiens
  misc_feature (10)..(10): n is a, c, g, or t
  misc_feature (12)..(12): n is a, c, g, or t
cattatggcngngggacatgggttggaagatggcgtctcccacagacgggacagatctggaagcatctttgctaagttttgaaaaacttgaccgtgcctcaccagatctttggccagaacaattaccaggtgttgctgaatttgcagcttccttcaaaagtcctattactagttctccacccaaatggatggctgagatagaacgtgatgacatcgacatgttgaaagaactggggagtctcaccacggctaatttgatggagaaggttcgaggcctacagaacctagcctatcagctggggctggatgagtccagagagatgacacgggggaaattcctcaatattctagagaagcccaagaagtagcagctgcttgcggacaggatgtcctggggtccgaaaccaagctcccttcccggtgcacctctaacaatgcacacctcactgcttgcttgggagaggccagagggtgtacctccaggactgccctctcccctgctcctggcactctacacgtctgaggacattcagcagcaagagaagaatctgctctacccaaggatcattgcagttactcaatcaactttcagacttgaaccttcttagcctcggatattggtaacagctgagggcatatcattcttaaaggtcgaagtcctgctttctcatttctggaagtgattcaggagccccaggatcttacggttgatttgactcagtcatggcagtcagttgtgacatgttgattggatgggttcttttgaattgttcttgatctcttagaaagtgtttacgatgtgaggagaccagagaccaagtagattctggaccagaccatgcagcctgacctgtgaactctccagtatatactaagttcccagaatccccagctgaagaaaccagaatcttctcgaaatgtatatctgttttttaaaacttctatacctcttatgatagtcccatttgcttttcattccttacttcccagccccaccttctagttctgacttcgggcagagggatccctgagtccctcctggaattagcttgtatagtgaaaggcccatccaaggttgtctaaagaccaatgtgaaggtgacagaaaggacttttgagttctaattaatctgttacagcttcaagcaagaaagtcagtatagcctgaaagacaagagaaacgggatggtttataggagttcccatttggttgaaagctagaagccctaattgaccttaaagtaacatgctatgggatggtgggattgtcccctctgacagcacatatgaaatagttcatctatataatagaaacgcacacacacgaaagagaatcttctgacttaaatacaactttcatggagttcttcaccacttatctgtctctgttaaaatctgcagtcccagcatctgtgttttgagagtgcatgaagtttctaactttgacagaagatat

SEQ ID NO: 1622 - DNA, 677 bp, Homo sapiens
  misc_feature (10)..(10): n is a, c, g, or t
  misc_feature (12)..(12): n is a, c, g, or t
cattatggcngngggacatgggttggaagatggcgtctcccacagacgggacagatctggaagcatctttgctaagttttgaaaaacttgaccgtgcctcaccagatctttggccagaacaattaccaggtgttgctgaatttgcagcttccttcaaaagtcctattactagttctccacccaaatggatggctgagatagaacgtgatgacatcgacatgttgaaagaactggggagtctcaccacggctaatttgatggagaaggttcgaggcctacagaacctagcctatcagctggggctggatgagtggtctccctctgtcacccaggctggagtgcaatggtgtgatcttggctcactgcaacccctacctcccgggctcaagcaagtcccccacctcagcttcccaagtagctgggactacaggtgtgagccacagcgcccggccagaaatgcttttttaatataactgagattagtgtgtgtgtgtgtgtgtgtgtgtgtgtgtgtgtgtgtagttataacgttgtgctttaaaaaattttattctatcttaagcattttcctgtgtcattaaagagttctaccagctgaagatttggaataggaaagatacacacctttagggaggcattggtgcacaggatagagtaggatggtagagagaggaggc

SEQ ID NO: 1623 - DNA, 430 bp, Homo sapiens
tatttttagtggagacgaggtttcatcatgttggccaggctggtctcaaactcttgacctcaactgatccacccaccttagcctcccagagttctgggactacaggtgtgagctacagtgcccggcttccattgcctttttattttttggttttgaacatatttgtgaaacctagaagtgaattgttgaccagcaaaagtttactctgttgacttttaataaccttaccctgctcatcctgatgatagggtattgacataatcagaaggcacagaggtgagctgcaaggttatgtataatctgcaaagtagataatctctctgtggatgattgtaatctggcatcttatttagccttagatgtgatatataagcaggttctgtaagtcttaaaattatttgtttcattgactagaaaaaggattactaga

SEQ ID NO: 1624 - DNA, 595 bp, Homo sapiens
actgatggaaaggcccttgtcttcctgaagctcaaagacattccaacgtcctttcatctcccaaaatattttcactctaccaaggaacaaactgcattagagtatccatctgcctttttatgattatcaaccaccaatatttgttgtctagtagtctgaggcatattagtgtagcaggaaaaataatgctggagtgaaaagggaagaacagcataggtctattagccaacctgagaaaatgccttaccatacctttcacaaatcctaaatgaccctgtaaatgtaactattgggctttttgtttctagaatcctagaaagatcatggtctttggagtcagatagacctggattcaaattctacctctgctgcttaaaactctagaactagttccttagccccagcctcagttctgtagaaacctgttttttggctcatacctaacagaattgttgtaaaaattaaagtaacaatgcacatcaaggccaggtatggtggctcaagcctgtaatcccaacactttgggaggccaaggtgggcagatttgcttaagctcgggagtatgagaccagcctgggaaacatggcgaaacctc

SEQ ID NO: 1625 - DNA, 313 bp, Homo sapiens
ttcttattgcctgtttgcttaaaatttggctttattctttaaagagtttttagctctaccatattgatttcttcattcaagcagttactaggtatgtagcagaagaatgatgatgatgacaatagtgatggagaaggaggaggaggaggagaaagacaatttgcttcatgaagacaggaacattttatgtatcgcaggtgcctaacacaagacctgggacatagttaattactctaattaatatttactaaatgggctgggagtggtggctcatgcctgtaatcacaggactttgggaggttgaggtgggagg

SEQ ID NO: 1626 - DNA, 601 bp, Homo sapiens
gaaagaaaacttaaagggtaactgatggggttatccttagcaaaattctatccctatgagatgaccctaagtggagccatctctatgaggattaatccagagattgttgcacacctggcagtgtcaggtctgggaaaacagttgctgatgttttcatggagtgtgaaatactgaaagctgcgggcatcccttggggaccactgacccacactttgaagaaccctcaatgagtctgaaagaggttcagtatctcttgggaaggatgtgttccaggctccaggcctagtcttacatggccagtggggttgaaagactgtgcccctgcaatggtcttttcctaagacagttgaacaaagttccaagtctgtctgtcctattttaaccatctttaagaagcacaaaggggatatgagaaaaacagatgctgaaatgaaaattttaactgatatcttacttatctcacaagtcgtgtaaagaaagaaatgatatggtcgaatattagattagatggtttaatgatgttttgagtgttatatatgagctatgatgagacctagaaaataaagtaaaaataaaaaatatataagccatgaaaaaaaaa

SEQ ID NO: 1627 - DNA, 328 bp, Homo sapiens
tatccagagtaagttccccaggtaggagaaacctaacatctatttaagcatttgtgcccattagaataacccttggactattctgtgcttcctggaaacctggatggggctccatggatgtgattcttcccattgctagggaaggatgatcacaccatggagacagagccaatgagagccctgggcaggggcatgtttatcagcattcaaaccctgctcccaccctggcagccctatcccacatccccaccttattgctcaccagtttttactactaacttgtattatccccagagcctacaggagggcctgccacagagtaggtgct

SEQ ID NO: 1628 - DNA, 209 bp, Homo sapiens
acgcccagccctaattacttctattacgccaaattccttgtgtggaattcctgtgctttgcacacaaattgccaggttggccccaaaggggaaaaaagtggatcccattttcccatcttctatgcctacgtggctgacaaatctcccgaatcccacaggagctgtcgctgatctttgtcctctattcgctgaaataaagttcaccatgg

SEQ ID NO: 1629 - DNA, 538 bp, Homo sapiens
aagaatttattgccctggtggcttcctttttttctttgtttaatttgcttgtgctgatgggtgagggagagttaaagaaatttaatggcctcctaactctctttccccgtgaaacccatttatctaagagatgccattggccttttaaaaatatccaactgattttatgcttttcctttcttttcatcttctgatctcggcactaaagggcggtggcatggctgagaggttggcatcagagcaggaaaacaaagttcaaggggaaaccaaaaattgggtaattttctctgaatgaccaagtgcttacttttttcaggcatgtgacattgctgttatcaagaaaccagttatgacatgaaaatcctgaaaatggaaaaggaaaaaagaaaaaaaaagggaatggggtgggggatggaaatagcaccagggttgactgacctttaccgaggagggaaggcgtactgttttcagcctggtgtcccccgtgtcccgattgcagccccctgtacttctctcttcatgcaccctcctgcatccc

SEQ ID NO: 1630 - DNA, 195 bp, Homo sapiens
tttaccataatgagtccacagcctcgggggacgattgttcctgtttctgtagaattgatttgaaacttgaataatgtcccactgggaggcaaggtgatcataaatgaagaaacaatagaagtctggggtcactagatcagaagatactattttaaatatctcaaagggcaaaaaatggctatagtagatgtctgg

SEQ ID NO: 1631 - DNA, 219 bp, Homo sapiens
gctggccggtggatagtactttgaacatcattagcattttctccaacagtatgatagatgttgtagaactaaatggcagtttatttaatgcttaaagaactatagtgcatttcagaatatgtagggattatgtgttcacagctaacataatatttattgtttctgagaaagtgaagattaagtcaaaggaggccgggcgatagagtgagactccttcac

SEQ ID NO: 1632 - DNA, 209 bp, Homo sapiens
gctgtattcatcctacccatctaagtaatcttttgataatcagatatttaaatgtaaaaattaaaaaattctaaaatgagtaagagaagatatgaatgaatatatcagtatggtgggagttgctctgaaccatttgtggttcaggatgctgcctgatttgccagaagaaaaaaagtaaaaatattagcatggtgataagttatgaagcc

SEQ ID NO: 1633 - DNA, 324 bp, Homo sapiens
tgcttatccaagtgctaatgagcagaaacactccaaagctgccctcaagtccagccctcaattcaaactgctcactggggagggctcagatgttatctactcagggagctaccaaattcttactatctaccagagggcctggtacatgggagctgttaataaatatttatagaatgctaagtgaataatcctaaggggtacacagtattataaatcccaactgacaaatgaggaaaattaggctctgagattttgcccaaaagcttgatccagaagctggactttatgtttcactttcttttcattatgtctcactaccttctc

SEQ ID NO: 1634 - DNA, 259 bp, Homo sapiens
gagatgcttagggcgaagtatggggatatgggtgcagtgctccatgcccttcccagatgcatcaccctccaaaagctttcacgtgttcagctacccagaagctctctggacccagtcctcttggcttttcatggaagcttcatgatcttagtattccttcccccaggaaactggggaggctgtcgctggggagggtcttaagaaccacaatcaggccgggcgcggtggctcatgtctgtaatcccagcactttgggagg

SEQ ID NO: 1635 - DNA, 1107 bp, Homo sapiens
tgagacgagcctggttaacatagtaagacctcatctatactaagaaaacttaaaaaattagcatggcatggtggtgtgcacctgtggtcccagctgcttgggaggctgaagtggggagtgtcacttgagcctggcaggttgaggatgcagtgagctatgattttgccactgcactccaacctgggcaacagagcaaggcgtgcctgaaaaaaaaaaataatgcacacaaacatccatataacatcaaccctagccaaaaaataagagagtaccaccagaagcacgactaaccaactgtaaatagagaaactgtaaagagggtcaacaaaatttataagttgttatttgaaaacactagtaaaatcgttaagcttcttatgagatcatcaagggaaggtgagaacgtgaataattggttccaggaaggagaaaaggaatattgatatggatcatatagatattaggagattataagataagctggtcttgaactcctgacctcaaatgatccactcaccttggcctcccaaagtgatgggattataggcgtaagccaccgtgccccaccttcttttctttctttctctttttttttttttaaagagagagcatctcactctgttgtccaggctggagtgcagtagtgtgatcatagctcactgtagccttgaaccattgggttcaagccatcccaccttaatctccctagtacttactgctggaactatggcacacaccactgcactgggtgaattttaaagttttttgtagagataagattttgcattgttgtggaagctggtcttaaactcctggcttcaaagatcctcccacccagccagtgctaggattattgacatgagccaccatgcccagcttagtttgtttaacttttaaaaaacaagtcaaatcaactcctagatgcatacccaaaagaaaggaaaatataggttcacataaaatcttgtacaaaaagattgatagcaacataattcatcattataaaaaagtagaaacaacccatacttcctgttgaacaggtctgtctggggggaaaaaacctcaaatgtttatcaatggatgaatgtataagcaaaatatagaata

SEQ ID NO: 1636 - DNA, 514 bp, Homo sapiens
tgagacgagcctggttaacatagtaagacctcatctatactaagaaaacttaaaaaattagcatggcatggtggtgtgcacctgtggtcccagctgcttgggaggctgaagtggggagtgtcacttgagcctggcaggttgaggatgcagtgagctatgattttgccactgcactccaacctgggcaacagagcaaggcgtgcctgaaaaaaaaaaataatgcacacaaacatccatataacatcaaccctagccaaaaaataagagagtaccaccagaagcacgactaaccaactgtaaatagagaaactgtaaagagggtcaacaaaatttataagttgttatttgaaaacactagtaaaatcgttaagcttcttatgagatcatcaagggaaggtgagaacgtgaataattggttccaggaaggagaaaaggaatattgatatggatcatatagatattaggagattataagataactcagcttgagctcaggagtttgagaccagcctgg

SEQ ID NO: 1637 - DNA, 264 bp, Homo sapiens
aaacaaatattcctgtacattgattgtttcacctacaataatgaccttctaattcctaatgattgttttctttttagtttcatgtacctcctaacatctctgcagcattttaacactgttgaccaatcagttttcttcaaactctcttctcctttggcttttgaaacattgtagtttcctaatattcttcttatttcttacgagttttactgttccccttttaccacctacttttaaaataaaagttatttccagtggatcagc

SEQ ID NO: 1638 - DNA, 225 bp, Homo sapiens
gagcagaacagttttcagcagtacaagggcttaaccaaaggcagccaagaagaaagaaaaggggccagatccggaagcgaactctgtagtacaattaacaccagggggcttatggacatagggatggtgggaaagggaaaagttaaagatgactcagatatattctccactgtgttcctagaataaaacctgaccacattaatgctcagttaacatctgtaaaat

SEQ ID NO: 1639 - DNA, 418 bp, Homo sapiens
ccagactggtagtagtggttgtctttgtatgattgtgggtaaatttaaattcccttccacctttatgattttcattttttttttttttctgagacagagtcccacactgttgagtgcagtggcatgaatctcggctcactgcaacctctgcctcctgggctcaaacaatcgtcctatctcagcctcccaagtagctggaactataggcatgtgccaccgcacccagctaatttttgtatttttttgtagagatggagtttccctatattgcccaggctggtctcgaaccttctggactcaagctattgttcacctcagcctcccttttgtgatttctaatttatttttagtaattaacaaatatgtattgcttgtataaattttttcaagctaaaataaattccaaattggctttcat

SEQ ID NO: 1640 - DNA, 494 bp, Homo sapiens
tgatgacttaaggggacaagccagttctgtggccattggtcatgttttaaagcagagaatgtgccttccacatgcctctgtagtctcatccccagtcactcagtccttaaattcattcacatctttatcatcatcaccaccatcaataagtgatgacgttacatttatctaaccatttcaacacttttttaatagattatacctgatagaatagtagactaaaagttttgtatcctacaggttttaaatttaagttgaaggtctactttttctataagtacttcaccatgaagcccacctgttttataaagtaatatattttattttctcaccccaatgtacctatgtaattttatttgtttttgtttttgctttttttgagatggggtcttgctctgtctcccaggctaaactgcagcggcatgatcatatctcactgcagtctcgacctcccaagcgatcctcccacttcagtttcccaagtagctaggact

SEQ ID NO: 1641 - DNA, 454 bp, Homo sapiens
aggtacttaccccagacaacgacgccgcttcaccatgatgatggacaacaggcaactttttttttggagtttcagcttgcttccaacagggacggtgagtgtgaggtttattcccatttctaagacgatagaagttttcagcctaagccgtattcctaggtaagcagctggattgcagttttgtcttggaaattctcctgaatgactaaaagttaagattaacaactagctggtcttaatttctccttaccattagagtacccagtaatcacataaattctgcaatcatctgtttatttagcttaactgtttttttttatttgttgaagttgttgttgttatttcagtctttttcttattgggttgaccagacttggtaaaatctgtaagaaagttccataattatggggaagatttcctctgaattggctaaattcctgtagctgaaaaaaaa

SEQ ID NO: 1642 - DNA, 654 bp, Homo sapiens
ttgatattaaggagatgccaagaggcccaactgggggatgtataggagtggaggaacaggccagtgccttaaagttctcagtaacaccagcttcctgtcagctgcaacctggtgtaaaaaaggcagagagtagtgaagaacatgttacaccaggagagccacctggaaaacaaaatggatcatttcttgactttcatgtgggtaaccagttccccaccctcattcgaagtttccaggtagtaatttattcaatgatgcaggtctaatgactgtctttggaagagggccagaatctgtcctgtggaggaggtggtggtggtatggtgagggtagtggcctccctgctgttttcaaaatcacagactaaaagcctttgattgtgccaaagaaattcattcagagcaattaactgcatggctagaaatgctttcttctctgataacttaacaaaactccagctgtcagtctttatgaagctggttaagtgtgttcatcttttccttgctcaagtgtgggctatggaaagaggtgaattgcggtgacttctgtggtgaggaggcttcagtgttctgagaccatgcttaaaaaattcaaatactcttaattaaaggggcaactcatcttcttatgagatttcaggccccaaataattta

SEQ ID NO: 1643 - DNA, 1011 bp, Homo sapiens
atatatgtgtgcatatgctgtgtgtgtgtgtgtgtgtgtgtgtgtgtgtgtgtgtgtgtatcaaacttaataaaacattgttacaagagcctggcagtaggagatttgataatcatgttacatttgccactcctccaagatgccaaattctaagtgtctctatgaggacttaacatttacttccttgtaataaatgtattgcttttgcagtgggataacaggaaatagtttgactgtcactcctgagcacatgcgtgtactatatgggttaggtgtttgtgtgtctatgtgcccatcccacatatcccatatacaaatgtagatttttttataagccatgtgagagtaaagttctgttaatttatagtcaaaacatataatttgcccatacatacaattcctttattgaaattctgaccacatttaaccttattgaaagcttctagcttgaatgagttttgctacattgaataaatactatgctgtatagttatttatgtgcttaagaagctgaactttcattccatcccagtaagttcccatgggataagttattttagtaaatcagaaaatttctctgaaagcaaagtaattcttaatttttggaggcttgaaaatggagaaaatagccatacgagttagcgggaagaagttctcattgattcatatcgctaaaaaataatttaaaatacttgtactcttaaattatcgtgagggggaagaacccaccacagtgctgctgaattgttttacttctgggattatatctttgtgtgtttataggagtgggaacattttatcttctgtgtttctgttgaggttgtttttcagcagtgccccaagaaaagtcctggagtctagctttgaagcccggtggacaagctggatatcaaagagccagaggaattcagcagtaattgttttatgactggccagaaatcagacctatttgtataggtagcacacaaaatagctgtgatttgacaatttggtgctatttatacccaccat

SEQ ID NO: 1644 - DNA, 479 bp, Homo sapiens
ttagggcaagggaagccagtcctcttagctcgcactgtcctggtggctgagagagttcttggaatgaaagaccttcctgtgaaccccagaattgctgagagggagggctgctgctgccccaccccacctgcatgcagccttgttcaccgagctctgtggctggttgcaggaaaggagggtttactgcacagacgaggggtggcccatgggctgagggcaggagacaaagctcagccaggtgcctaggacctggacagcagaggccactcctggctgccctggaactgcactctcttcttgctttcccttgggcatcttttctaggcacccgcctcctccccatggtggagcaccagggctcagttaggcttccagtcagcccaacccattcagcctccagggttccagttcccacatccgaaccctggttttgtctgcactgacagcagagccctgccctgagcagagccccctgggaa

SEQ ID NO: 1645 - DNA, 423 bp, Homo sapiens
cattgacaatttattgtctgatgcaatgtttcttaatctttttgggtcttggattcccttgagaatcttttgaagtttatggactcttttcccagaagaacacactcatgtgtatgtaacacaattttgcattcaatcttagggactgcaggtgtctacattagttatatattggtgtaaaaaaaaaaagccccaaacttaaggcttaaaggaacaatagatgcttattatctcacagtttctgtggttcagaaagtcagtaacatcttaactggatacttctgactcagagtctcccaggaggttgcagtcaagatgttgttggggggaaaggggcaggttcagtggctcatgcctgtaatctctacactctgggaagcaaagccaggaggattacttgagcccaggagtttgagaccagcc

SEQ ID NO: 1646 - DNA, 391 bp, Homo sapiens
atcccattccaaaagggaaaaactggcaagaagaggggagtaacagtccctgggcaagtctgaaatgcatcagggcaggcattaaatcttaaagctcccaaataatttaatttgactctatatcccacttcctgggtgcactggtaaaagaggtagaccaccaaagcctcaggaagccctctcccaaaggctttgctggctgaagccccatatggcttctctcaccacttgaatcaaatgtctgtgatttttccaggctaagggtacacactgtcagtggctctaccattctggggtctggatggtggtggccctccttccacagctccactaggcagtgccccaatggatactctctctggggactccatctctacataccctctcagcc

SEQ ID NO: 1647 - DNA, 446 bp, Homo sapiens
tgtagcttttgtaaaagttttggaaatggcctcagataatttcagaggtttttaaataaagaacgctcaaaatggagcaaaatggagagcccctgataggcctcctgcgtggaggtttgcagtaagccagaggcacctgtgggtcccagggagagacgggctgctccatggatgctcctgggacctggggcactgggtgggcctcaggcagataggagctggtccgtatctcttgccaagcccaggccaactcctgatgaagcagattcctgtgggtgacaagtgtcagaagatagaataggaccttagggtcaggaaggatttcttgaacaaaaaaggggaaaaacagattgagagattcagaaagctgtaatatattctgtgacctcaaaggtgacttggaggagggctgttgttcagcgacgggcgtgtagtgaacactgggg

SEQ ID NO: 1648 - DNA, 512 bp, Homo sapiens
tagtgcatacattttaagttggggttattcaattaaagcagagtgggtgttccactgcaagccccctccaccagcactcatttgcttttggctggaagaccgggtgtgtgctgtgcatggcccagtctcttctacaaaacacacctgtctcaagtgggttgggggtggggggcactcttgccgagaagtcgctgtcacagtcgtgagctgaggacatctgcactgtggacatccctccaccagagccgtaagagccttctagctgcagagtggttgtttccacatggccacaattctgattgggggtcctgggtcacttccttcaagttgagagcctgggtggtgcacagtgtgaagtacacgtgtgggcggggaggggaggttacagcatagatgtgtaaacttaatttttttaaaaaaggaaaaatacctaagtttaaaaaatgactttctttgaataataagattgggttaaaaattttggagaataaagtcaatatttagtactatca

SEQ ID NO: 1649 - DNA, 534 bp, Homo sapiens
tagtgcatacattttaagttggggttattcaattaaagcagagtgggtgttccactgcaagccccctccaccagcactcatttgcttttggctggaagaccgggtgtgtgctgtgcatggcccagtctcttctacaaaacacacctgtctcaagtgggttgggggtggggggcactcttgccgagaagtcgctgtcacagtcgtgagctgaggacatctgcactgtggacatccctccaccagagccgtaagagccttctagctgcagagtggttgtttccacatggccacaattctgattgggggtcctgggtcacttccttcaagttgagagcctgggtggtgcacagtgtgaagtacacgtgtgggcggggaggggaggttacagcatagatgtgtaaacttaatttttttaaaaaaggaaaaatacctaagtttaaaaaatgactttctttgaataataagattgggttaaaaatgtatattgagaataagatggccttttgaccttttagggtctagggctgtaaacgt

SEQ ID NO: 1650 - DNA, 369 bp, Homo sapiens
ggagacaggaaggagaatgccaggtcagatgttgggctggaccccgcgggtggatgggaggtggcgtgtgtcatccaccaccctcacccatccttgttctttgtgcaactctcacttctcttttcttttcactgttgctttctggcctgacccaggtccctgagttcccctatggcctgcctgcctcctgttcctgtgttgtgaagagtggggagcaccccctcaaaagcagtgcctgccagacgccagcacattctgtgtgccagtggggcctcatgcgacagtgggaatgagaaaaattcactctttcaaaactcactgtcagtcctttaattttcctcaaaataaaagttttcttctggtgtccgt

SEQ ID NO: 1651 - DNA, 646 bp, Homo sapiens
ggagacaggaaggagaatgccaggtcagatgttgcagggttagactgggcctggtttttgggcctcgttctccctggcccctgagggctgtctgtagctgtggcccctgcagggctggaccgggccttgctcaactcccttcaccaggcccgcagcagggaagtgccaggaagtgtctgtggacctgggttgacttgggccttgggtgattttcttcctgcttcctttgtgggtcccccactctgcctgagctctgtcagccccacgaggtggcttccgctctgtagacactgcctttgggcaccgttaggggctggaccccgcgggtggatgggaggtggcgtgtgtcatccaccaccctcacccatccttgttctttgtgcaactctcacttctcttttcttttcactgttgctttctggcctgacccaggtccctgagttcccctatggcctgcctgcctcctgttcctgtgttgtgaagagtggggagcaccccctcaaaagcagtgcctgccagacgccagcacattctgtgtgccagtggggcctcatgcgacagtgggaatgagaaaaattcactctttcaaaactcactgtcagtcctttaattttcctcaaaataaaagttttcttctggtgtccgt

SEQ ID NO: 1652 - DNA, 319 bp, Homo sapiens
agccactgcgcccagcctcaagaccagactactctttaaccaggtcatttctcaaggttggatttgcagtgagcagccctgaaagataaggtaaaatctttctctgagacaaagagtcggctttttactgcttgttataaaagtggtgaattccccaaacttagtgttcctcagctatacaaacccactgtgcacatagcaaccatccaagctatatcacaccaccatatcacacagaactgtggacaaagggaatcaatgcagatatgttgatgctcatgctgtttgctgtgccatgagaaataaatacttttgcctg

SEQ ID NO: 1653 - DNA, 287 bp, Homo sapiens
gtttgaccatttgctcagctgagcttgtcttaataattggattcgtggttaatgagccccacatgggcgagagagcggccttcattctgaacccatttaggcagcacgggcagccctcctcgccgtgggcggcattagagcccaccctgcccagtcttggggttgctccttgatgctgtctgggaggcttgctcatggtgacatccttatctctccgtgcacgttaccgcattcagagcttgggtcacgtggacactgaactcaggcgaattttctctgagatcccg

SEQ ID NO: 1654 - DNA, 364 bp, Homo sapiens
agaattatcaaaggatggctgtacagaccacctagaaaataattcagtatttcaggtttttcttttctgggagtgtgataactgaaattgttagattttggctcagttaagaaaagaaagatctgttgcctttcttctgagtgaacagtggtgagaaaaaattttgcaaggccccgcttttcctttcttcacaggccagcagtagccatatctgatcaaaaaagatacctgaaggaatattgatcacattttcctgaggccctagcaagcacaggaattgagaagttaggactggaacaactttgtcatttgtcacaattgccaaacattagaatacacaggaaccgttttttcaggtaactct

SEQ ID NO: 1655 - DNA, 156 bp, Homo sapiens
cataagattcacctagaataagactagaaagttataccagatatataataatcaaaagaaagctggaatagataatattagacaaaatagaattactagagagagaatcatcaggaagaaaattctagacctatataaacttaataaaatgtctta

SEQ ID NO: 1656 - DNA, 2516 bp, Homo sapiens
cctgtgtctgtgggccttcctcctggtgtgacagacttggggatttcttgtaaacttcctaactagtctgaacctttttatttcttattgggaactgacacttccctatactttaaaactcacatatgtatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttattatattttcagtaaggatttggagatttttggacatttttactctcataatctatgcagtactgaaatgaggtctaataaatataaccaatacatgttaggccataggttcttaaatttagctacctgttcacctcaacttgagagctcttaaaaccctcagtgtccaggttgcagcccagactagttaaataacgttttatccctagaaatgttttttttaaagctacccagatgattccaataggcgtcaaggctaatagccactgattcaggccttgctattcaaaagtatggtccgtaaaccagcagcatccctgagagcttgttggaaactagaattcagggatcttttgtagacctactgagacaggcgctacctgtaccaacatctctagatgattcctgtgcataataaaatctgataaacaaaggcaataggttattcttcctgtgctggtaaatctctggcaggggtccccagtcaggaaaaagatttgagtattaaggtctttcaaaaaagttaactggccatactcaactgtctataaaacctctataaatttctgtttttatgtctatgaattattaaataaaatttaactcatttttaagaaattacattttctgttatcaagaatacaattcttactagatcataggtgaaaatgtcaataatgataggagcaaattaaaaattcagataattatttttgacttttctagaagacataattatctctggaaagcatatacagtagtctaattccaactgctactcattaagtattggatatgtgataaaaactctatcgataactccaatgtaccttctctaatgtactgtaaatttccatttcctatcatgtgcttgcaaacaaagatttcctatgccactaaactcaataagtgagaagcttgcacattatttcattttgctatagctacgatacatatcaaatgacagctactcctggtccctcatttgtatgttaaattccttgttaattttatgacaagattgttgatcttggatttcactttcattaccgtcttagaaacaaattggatttttctgctcccagatgccactagagtagctttgtaaagctcattttcttatctttacttagtttctgtctctaactttagtttcctttttcagcttccctgactaattctcttaacctccaattatctttaacagaagttactaattctgcaattcatatattctggaactggaattatctttgttcctaagcaaccaagtatacatatgaaacggtctgtacattaatgcctcataatagcagctcttatttgggaaagggttatagtacatttaaaccatgtggttttccaagcaagttaagactggctatttgtgtttagtgtcagaatatgttgaattagaagttgaagagtttctaaagtgattttaagggcttgaggagagatgaacccttttgcttagagccagaacttagatatggggtgtaaatatttatattacactaatcattaagagtaatatatttaattttatccatttttttagtgccttttttgaaccaatcactgggctagatgtggggaggacaaacatgtaagcaaatcactgttagaagtaacttgtacaaagtgtgtaaaaggacacagtggtgaaaggggtgacttttaggagaaactttatagagcaaggaccagtaagtttacctaaaaggggaagaagaaatatggagaaattaagtgggaagatggggaggggaagtgtgctaatcacctaagaacctccgtgctacaagaaggagtttgggtttgaccattaggagaaacaattacaaagctgaagcagcatgctaaactgcatttcacaaataccactttggcagcatcaaggatcgattggaggaggcaagactggaggcaggaagactggttaaaaaaatgcatattaggaagatatgagagaaaaatgataatggccttatcaaaggcagcaataatgttccttgcaataggaatgaacagaagtcaacaggaaatattaagagatgggatcaaaaggacatgactgcagattgctgtttagagttatggaaaaaagtagaatccaaaggtaaatctcagatttcttgagtggtgggagagatgatgacacaaaatgtaactttaaaaatggtaattaaaaaaaaatgttttatgcaaaaaataaaaaaaa

SEQ ID NO: 1657 - DNA, 295 bp, Homo sapiens
cttgatgtggatgcttggatggagagaagagagttctgcacatgaggtgccctcagccacgattactgtggcagtcaggagggatgaggagaatgtgtgagaaagactgtaaaggaagagtggacatgacttgagggaataggttccccgtagctgagtgaaagcatgaaggagaggtaaaggagaaaggatttgaagattgcttcactttgaacaggatgcagtcaagaaccatggcactaatggtgttaaggaagttaaggagttaagggcttagagagaagacagcagtttg

SEQ ID NO: 1658 - DNA, 512 bp, Homo sapiens
tggtcaaggaaggccttaccaaaaaaatgtcatttgagtgaaaacttgaaggagatgaattcagctgtacaaatccagaaggaaaattaaggcacagcaaacagcaaatgtagagccctaaggcaggacctgcttttactagaatagcaggcaaatacctggaatagaattagttagcaaatttggcagggaaaggtagcagtggtaggatagtaacaggaggcagtgtcagactttctttgacttagatgaaaagccaatcgaaggtttgaatggaggagtgacatgatttgagcctgctttttaactggatcagtctggctctcctaatggtaataggccaaaagaaggcgagacaaaacaggacacaatttaggagatagcggtaatcaggcaagggaagatggtgacagcttggtgtctagggtgcaagcagttgaagtgatgagaagtggctggactctggctatattgtgtacattgtggaggaaaagacctcaggagttgctttt

SEQ ID NO: 1659 - DNA, 449 bp, Homo sapiens
cagagtggggcttccaatccgcagatccagagctgactctcttaaatatctgtggtatcctccctctttaggttgggtgctttccctcaaggattttaatatctaataggggaaataacccatataagttacattaaacatacatatgaaagcaatgcttaaaaagttgtgcttttgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacag

SEQ ID NO: 1660 - DNA, 406 bp, Homo sapiens
atataatctgagaagagacatttatttgagtttttccttctaagagaatatgtacatctcccttttctttaaaaattttttattgtgaaatatgtcattaatatgtactgacaaagcgtatctgtgtaataaatatgctttttgtcagtacatgttaatggtatatttcataacaaaaattaataaaagctttagaaactttagttagtttggaaaccttttgtgtgtttctaccccaggaggaatgcgttccctgccccccgttaccctggccattattaattttgtgttaattattcccttgcctttttaaacagttttatcacctatatagatatccttaactagcattgtttactcttacctgtttttgaactttatttaaataaagtcattctgtattcta

SEQ ID NO: 1661 - DNA, 510 bp, Homo sapiens
taaaggacagggaaatggaccaccccaaactgatgtacattggttctgctcatcacacttgggggtctcaacaggctgatctgtgttatcagcaagtctgctgatacttatcagggacttgctacagagacctggtgcttgactctggaagaaaatcagcatcagcaatgtcttcagtgcctgtggaggataaattatatgtgtacaccttaatagataatctccacatccctgtgacacactgcaacctccagggaccttagcaatgccgatgttctacccaggttttgcaggatggctgcctggtcctcagagtttgcttacataggaggtgaactcaactcagcacgcacagttatgtggggcgagcatcttacaggatgcaggctacgcaagcctttttttctaccagccaaccaattaaacgctgacaatactgattcaatgtttcctttcccaaagttctcccatttccttttttgaaaataaatctgttattgaaaattgaat

SEQ ID NO: 1662 - DNA, 267 bp, Homo sapiens
ctttttttttacattgagcatatagtatttttataatgtaaagatataaggctgtattcgaaataaatttaaaaacaaggggaagatggaaacataaccagaaattttcctttgttaggtattaacagataattcaaccttggatctaagttttgtaactccagatttatgcaaaaatattctttttttttttgagaccgtgtctcactctgctgccaggctggagtacagtggcacgatcttggctcactgcaacctcctcctccc

SEQ ID NO: 1663 - DNA, 296 bp, Homo sapiens
tagaacacgtgctaagccatacaacaaattttattgaatttaaaaagattcaagtcatataaagtatattctttgaacaatggcagaaagttttttagtaatatccaactattgaaaactaaatagcaaacatataaataactaaatgaaaatgaaaaacaaggtgtcacaatgggtaaaatgccagtacttaggaatggagttatagcactgagtacattcgttaaaacataagaaaggtctcaaatcaatgacatcattcatattaagaaactagaaaaagaagaaaaaattat

SEQ ID NO: 1664 - DNA, 372 bp, Homo sapiens
actacagcaacagattagaacacagtatccacaaattgacccatgattttactgaaattgaaaatatgcaaaaggtgccatttaaaatcatggattatttaataaatggcagggtgattgtctttttttttaaagtaaactgtgacacatacataaagggcccactggaagcctgagcaatatagcaagaccccatctccacacacaaaaattttttttaattagctgggtgtggtggcgtgtacctgtagttctaactactctggaggctgaagtagggggatcgcttgagcccaggagattgagaccatagtgagctatgatcacaccactgcactctagcctgagtgacagaactagacctggtctctt

SEQ ID NO: 1665 - DNA, 343 bp, Homo sapiens
caaacaacaatgaaaataacagcaacaaacttatctccagcttcagccttccatgttgcatagtgtctggcatatatccggtagatgttcagtacgtgggagctgtgttttacataagttttctcattccaatgctgaaaacagagaaaaagattgaatgtcatgcctgcatcgacagcacatatactaaaattggaatgatacagagaagattagtatggcccctgcgcaaggatgacacgcaaatttgtgaagtgttccatatttttccgctgccaccaccacaccgcactacctcccacccccttttgtgtacaaaacacaaggaaaaatatttttgttt

SEQ ID NO: 1666 - DNA, 404 bp, Homo sapiens
gggaaaaagtgaaacatgatgaaatattgatagtaaaaggatagatgtctacatttaaccttgaaggataagtagttttttggatggataagaagaatcatgggccgggtgccgctggctcacgcctttaatcccagcactttgggaggtcgaggcgagtagatcacgaggtcaggagttcaagaccagcctagccaagatggtgaaaccttgtctctactaaaactacaaaaattagctgggtgcggtggcaggcgtctgtaatcccagctactcaggaggcagaagcaggaaaatctcttgatcctgggcggcagaggttgcagtgagccgagatcgtgccactgcactccagcctaggtgacagagtgagactccatctcaaaaaaaagagagagagaaaa

SEQ ID NO: 1667 - DNA, 212 bp, Homo sapiens
agaagggtcaatttctgttgaaacaaaaaaaactatgggactattgggttcatttcaaaataagggtctaacttaattcttttgcatgtggctatccagttgtcccagcaccatttgttttctttcctcaccgaattttcttggtaccctagtttaaaattacttggtcatagatacatgggtttatttctggactctcaattttttttttt

SEQ ID NO: 1668 - DNA, 337 bp, Homo sapiens
agaaatttatccatctcttctaggttttctagtttatgcttgtaaaggtgttcattgcagccttggatgatctcttatatttctgcggaatcagttgtaatatctcctatttcatttcttattgaggttatttcgattttctctcttcttttcttggttaatattgctaatggtctatcaattttatttatcgtttcaaataaccagatttttgtttcatttatcttttgtattgttctgtttttcattttaatttcatttaattctgctccgatcacggttacttcctttctcctgctgggtttgggttttggtttgttctggtttctctagttcc

SEQ ID NO: 1669 - DNA, 362 bp, Homo sapiens
aatttaaaaaaatacatacacatatatattctaccagtgtaatcaagaaatagaagaaaacacaacattagataataaatgatttatcctacccaaattctgcaaataaatttgaaaattggatggaatagatgattttcttggaaaatgtgctagtagattgactctagaatagaaagaaaactcaaaaagtctctcaaaagtggaaaaaaaaaaagacaactgttatttgtgaccagttgctactgttcttcctggagtccctttgccattgctgttttgcaaagtgttagaagtgaatttctggtgaggaacctcggagtgtgaggcagggtgagcatcctgcttggtgagctctctgc

SEQ ID NO: 1670 - DNA, 267 bp, Homo sapiens
gcctggattaaaggtggtgcctcttgaactgaaaagatagagctcagaggacgcatgaaccaactctttaaaattcatgactgacgtggccaacttttctgctaatttccaaaatagcagagaaagtgggactgttaaaacgtggagaagtcctacagtcatcgttcacacctgtaatcccaacactttgggagacctaggtgggaggggccacttgaggccaggagtttgagatcagcctgggcaacatggtgagacctcctctct

SEQ ID NO: 1671 - DNA, 814 bp, Homo sapiens
gaaacaggagacattacaactaatgccagagaaataaaaagcaagaccataagggactattatgaacaaatttgacaacctagaagaagtggataaattcctaaaaacatacaacctataaagacagaattaagaagaaatagaaaacctgaaaagaccaataacaaataaggagattgagtcagtaataaaaaaccaacccaaacaggaaagcctacgaccaggtggcttcacaggttaattttactgtacatttaaagaagaattaatatcctttcttcctaaaggcttgtaaaaagtagaagagtaaatacttccatactcattttatgaggccagcatcacactgttaccaaatccagacaaagacaccacaaacaaagaaaatgacaggccaatatccctgatgaatatggatgcaaaaactttcaatgaaatattagcaaaccaaattcaacagtacattaaaaagatcatattctatgacctataaatctctataaagcaagacttattcctaggatgcaaagatggttcaacatacacaaatcaataaatgtgataacaccgcattaacagaatgatgggcaaaaaccatatgccaaaccaaagaaataaaaggcatccatatcagaaaacaagaagaaaaattaactatttgcagaggacatgatcttatacatacaaaaccctgaaaactgcacacacacacacaaaaactggagatctaataaacaaattcagtaaagttgcaggattcaaatcaacatacaaaaagcagttgtgtttctgtatgccaacaataaactatcca

SEQ ID NO: 1672 - DNA, 407 bp, Homo sapiens
acagcagcatgtgcatcccccaaaggcctccagtttgtttgtaaagtctcaggcaggaatctgcccttgtgatcctgaggcctcatgtttcagggctcaaagctggccctggggacaggaggtggcaactggtgtctgaccccctaaacctggtgcctccactgatcaacagaccagataagggacaggtcaccccctgaccttagggccttgaggcccagggcggggagtgggtggtggtgctgcagttagaggatcccattctcaggacagtaaaccctcgaaagaacttctcacccactattttccaagctttagtcacttgcattctgctttcataatgttgaccatttccaagttcccttgtatttttaaacttaaaataaagtgcatgtatcttaagtgta

SEQ ID NO: 1673 - DNA, 464 bp, Homo sapiens
gttttgccacgttggccaggctggtctcaaactcctggcctcaagtgatccgcatgccttgccctccaaaagttttgggattacaggcgtgagccaccgtacccaatccatcacttatatctaagtgtatatttgtacctgttaatcaaactctcttcatcccctcctctccactacccttcctggcctctggtaaccaccaatgtaccctctgtcttcatgagaagggatcagtctttactcagaagctttggccatggcttgagcagagtagctgtcagccatctcccagcaataccagccattggacaagaaacatgaaggtttgggatgactcatcctagaagtcattgttttctcagctccatagtacacatctacttggagatttataaggcatgcaagctccttttctggcctgtatgaaaaactggaagaggtagaatgagttccttgtaacccag

SEQ ID NO: 1674 - DNA, 1158 bp, Homo sapiens
actttttgtcctgaagcaacagttttctctagtttattattaatgagtagaccatgatatgtaataacatgtgactgataatgtgaggcattttggagatggtgctgttttgcaattaccaaaagaattaaatgctctgagaattggtctgttacttagtagctttaactacattttttatacaagtgctggtatttatagattgttcttctagctgcactctgaactttttgggagaagagaatagatcttcttgatcattttatttttaagaatgatagagaagtttatactgaaatgttgagtaaatcaaggaatgaaaaaatatacatgtgtgtcctaaaattaccttctgttctttcctttgacatagtgagtctagaggcttacctcccttgtaatgagagtggacttcccttagccctaaaccactggaactggcttttatgaagtggggcaaaggtttttggaaaagctagggctttgagggctacaaatagtgatcttaaaagctctcagtgttagccaggcgtggtggctcacgctgtaatcccagcactttgggaggccacgccgggtggatcatgaagtcaggagttcaagaccagcctggccaacatggtgaaacctcatctctactcaaaatacaaaaattagccagatgtggtggtgggtgcctgtaatcccagccactttgggaggctgaggtgggcagatcacttgaggccaggagtttgagaccaacttggccaacatgatgaaacattgcctctaccaaaaatataaaaattagccaggcttggtgacacacacctgtaatccctgctactagggtgactgaggcaggacaatcacttgaacctgcgaggcggaagttgcagtgagtgaaggttgtgccactgcactccagcctggcaacagagtgagattctgtctcaaaaaacaaaaaaaaaacaaaaaaaaaattgtggggtaaatttgagtgtatgagaatcttagactattgaatgaacattaatttttttaaaatgtccacttagaactatttaaaatataaacgtaaattagggttttaattatgaatataaatgagtgcatatctgtatattttacagaaaccaaaaatttaatattatagagaaatatctgtctttagga

SEQ ID NO: 1675 - DNA, 742 bp, Homo sapiens
actttttgtcctgaagcaacagttttctctagtttattattaatgagtagaccatgatatgtaataacatgtgactgataatgtgaggcattttggagatggtgctgttttgcaattaccaaaagaattaaatgctctgagaattggtctgttacttagtagctttaactacattttttatacaagtgctggtatttatagattgttcttctagctgcactctgaactttttgggagaagagaatagatcttcttgatcattttatttttaagaatgatagagaagtttatactgaaatgttgagtaaatcaaggaatgaaaaaatatacatgtgtgtcctaaaattaccttctgttctttcctttgacatagtgagtctagaggcttacctcccttgtaatgagagtggacttcccttagccctaaaccactggaactggcttttatgaagtggggcaaaggtttttggaaaagctagggctttgagggctacaaatagtgatcttaaaagctctcagtgttagccaggcgtggtggctcacgctgtaatcccagcactttgggaggccacgccgggtggatcatgaagtcaggagttcaagaccagcctggccaacatggtgaaacctcatctctactcaaaatacaaaaattagccagatggtcatttttaggacccacatgtatattttttcattccttgatttactcaacatttcagtataaacttctctagtcgac

SEQ ID NO: 1676 - DNA, 433 bp, Homo sapiens
agtatggcacgttacacatttcccacttccttcttttttagtttccttttagccattctcagaaatgtaagcaggaagaaaatagcaatcaattatgtttggaaacaactgaagttaaatctgactgatatttgtttataaaactatgcatcattttattttcagtacattttcagttcctcttttgcccctaacattctcctaattcccatggtgaatatatttcctttaatccaggcctgaacactgagatagttaacagccctggttgttatttcttgatgaagtctctcgtagtcagctccttttttcttcccattgccttcctttagtccaagttttcataacctctaggccctccactttgcagttcaatctgtgaggttaatgacttcacacctttttcattatattcatgccttcattcactgga

SEQ ID NO: 1677 - DNA, 877 bp, Homo sapiens
ttactcactagcgtttgtcattaactttgacgtatactgagctcttactatactgacgatgccctggactatttgattcgatactcacaattcataaagtaggtattattggtgttctcattttgcaggtgaggaaagtgaaatccaaaaaggttagatagcttgcctaagtgccaaagctgggtctcaaaaagtcagcccattgggctccagggcctgttctgagaaccttgacactagattgtttccctttagaggagaacagcttccatccctgtcttctaactctaccaaattaacttggcatttcagaacttgatttcccacatacagatacacttttcatgaacatttcccaactctcagagttagtttcttttaaaaggtgggaatgaaaaaacaaaacttggaaaatcatcctcttctggcaaagtagaaaggtggatccaggaaccttttaatttacaaatggaattcccagtttggccattatccagagaccatggatgggcaaattaaggccattgggctaaatccaaccaattgttggtttttttatagctcaatatctaagaatgattttttacatttttaaagggttgaaaaagaaaaaccagtcacaacgtgatatgtgaaaattatatgaaattcaccaagagtgagccctaatatattaactatggatgttgggtgataatatgtcaatgtgggttcattgattgtaataaatgtacctctctgattggaatattgatagtggaagagactgtgcatgtgcgggggcacagggtatatgggaaatgtgtattttctgctcaattttgctgtgaatctaaaacttttttttaaaaaaaggctattaaaatacatatatgca

SEQ ID NO: 1678 - DNA, 337 bp, Homo sapiens
ctgctgtgttctcaatctccagacggtccatgaaaatttaatgtataagaacaaagaggctgggcgcagtggctaacgcctgtaatacctgcactttgggaggctgaggtgggtggatcacctgaggtcagaagttcgagagcagcctagccaacatggcgaaaccctgtctctactaaaaatacaaaaattagctgaacgtgatggtgggcgcctgtaatcccagctacttgggaggctgaggcaggagaatcgcttgaactcgggaggcagaggttgcagtgagccaagattgcgccactgcactccagcctgggcgacagagcgagactgtctc

SEQ ID NO: 1679 - DNA, 553 bp, Homo sapiens
tcatggcagaaagcaaaggggaagcaagccaggtcttacacggcagctggcaagagagagcatgtgcagaggaactcccctttatcaactggcagatctcatgagacttactcactatcaccagaacagcccggcaaaaaccatccaccatgattcaattacctcattacctcccaccagggtccctcccatgacacatgggaattaggggagctacaattcaagatgagatggggacacagccaaaccatattattgcttaaacaaaaatcaagctgagggcactggaaataaagacatggaaatatctcagaatttagaacagagagataaagtagtaagacataaaaaagaaaaacaaaaacagaaattatcatttcaataagtaggagttctagaaacactaatctaactaaaaagttttagaaatatcagttagccattctagattgttaaaccatagtttttcaaatgtcaactaataagatacgtataaagattaacttctgggagttctagaaatctacttctgttagttaacagaagatctaac

SEQ ID NO: 1680 - DNA, 476 bp, Homo sapiens
aaagctggccataaagaaattaaatcccttattcctgaggggtcccaccccataccaggaaggaagaaatgctgcacaaagagaccaagaagaatctaaacaggcgggccttgccgaatttccccactttgtctcttcacgttagattgtacccctgtgttcagtcgcatttctacacaactgtccatacttctttgaaactaagcataaaaatagatagttttccctgtatctttgggtcttcattctgaaggctcctgtgtcaatgcaaagctatactccaataaatttgtcatgcttttttttgttaacctgccttttgttacagaggtgttcgccgtgaccgttacaatgaagaggaaagagatcatcccctttctactcctacatccccaagtgaagaggacatggagtacagccacagccacacttaaagggcatgtaacatgaacaaaaataaatgtttgttgtaagca

SEQ ID NO: 1681 - DNA, 686 bp, Homo sapiens
ataaattgtattcaaggctgactttgtagtgatgtattccatgaattatttcattcaaaataattttgaaaggacttctggtccagacaaaatagcatagatccatttctgtcttctctcctctcagttaaatgcaattataaagtctagaaataatgcaagaggtaaccaaaggagaactctgaaagatggaaacagaaagaggaattagttagggaccctaagactggaggaacaatagaggtaggatgtcttaccatcaccgcatccaacaagagaaggtgacctaggcctggtattacctgatcccaacttggcaccaaaagacagccaacatagactcattcctcctgcttcctggtgagcctggtattctcctccacttccactgacagacatgtagggtgactgggtggtatcaacaataggaaccacatcataacaggcagcctagtttgggaagcactcttggtctccgtaggcctgagactccttttgcccatctagaggcaccaggtggcccagcccatggaaattccctcagccccagaaaggggcaccagaaaggaccagtgggagctccagtaggctataatagtatgaaggctctgaaatgaagttgccactggacctacagcccactaaactaggctaggaccttaggtgatagcctgaaaaaaaaaaaa

SEQ ID NO: 1682 - DNA, 1321 bp, Homo sapiens
taactgggtatgtcctatatattttttcctaaatctcacaattctatccacactgcctttctatctttttcagctgggctatctataaggggcgagatctacctccctccatacccttgtgttcagacaccttatgaatatctgcagtcataatgtccttcaagaaagaaaacattggtcagctctaggtcctgcaaatgcgttttgaaggacgaactcaaatacagatgggataatcaagtaaatatcttcataggatcaatgccaccatgttcaacacttccctttgccagcctgttgtgaggtccaagtttccccattaatcccttatatagcatttcccagtaactgggacaaccaaaaacacaccgacatattagaaatgctcctgaaaagtggcaacaccgcctaactcagtaccaggacctcttttaaattcaatttcttttttctttcagagagataacaaacgaattcattatttcccccattcacatcttaccacaaattatttttatcaggttaaaactggtcatctacggaattgtagaaaggtgacataggaactgtcttcactgctggaagaataaaagagtctgaggtatagacactgccctggtgacaccttctcagaacattgttgggggacaggggaggcaggcgcaagtaggggatagaatctgaccctgacatgcagctatcacctggcagagagactcgtcaaagcaaattataacgaccagtactatttttttttggaattgaaaacccaagaagccctaaaataagaacagtgagatcaaaggctggtttctaaaacaatgcagaaaatagaaccatgttggaattcctaaattctagctttcaaatactactgtttccaacagtgaatccttgacagagactgaatgcagatggaattttgaaacattttcagtagctacctcctctcctgaaattcctataagtggcagaggaaaatccaaatcctttaatataacatgtccatctcatgactcctgcttacacacatttgtgttgatttgcttcatttctggaggatgggaatttgcagagctggtgacatttccttcattagacaccagaaattcaccagagagagacagatctgtgccttctctttttaggatctggttattgatactttaataaatgtggtgtaaagaaaatccatggctacagtctgtatagaaaatgtgaattttttaaataagattgtgttcttaatgtaaaaaataaaagtttatttgtattcagtgaaatgcctaataaagtcctggtaccaattaactttattttt

SEQ ID NO: 1683 - DNA, 631 bp, Homo sapiens
  misc_feature (10)..(10): n is a, c, g, or t
  misc_feature (44)..(45): n is a, c, g, or t
  misc_feature (57)..(58): n is a, c, g, or t
ccccctgggnaaaaaaagaccttcggtcaaaagccaaatttatnnccgacccggganntttttttttggaattgaaaacccaagaagccctaaaataagaacagtgagatcaaaggctggtttctaaaacaatgcagaaaatagaaccatgttggaattcctaaattctagctttcaaatactactgtttccaacagtgaatccttgacagagactgaatgcagatggaattttgaaacattttcagtagctacctcctctcctgaaattcctataagtggcagaggaaaatccaaatcctttaatataacatgtccatctcatgactcctgcttacacacatttgtgttgatttgcttcatttctggaggatgggaatttgcagagctggtgacatttccttcattagacaccagaaattcaccagagagagacagatctgtgccttctctttttaggatctggttattgatactttaataaatgtggtgtaaagaaaatccatggctacagtctgtatagaaaatgtgaattttttaaataagattgtgttcttaatgtaaaaaataaaagtttatttgtattcagtgaaatgcctaataaagtcctggtaccaattaactttattttt

SEQ ID NO: 1684 - DNA, 860 bp, Homo sapiens
  misc_feature (751)..(751): n is a, c, g, or t
  misc_feature (766)..(766): n is a, c, g, or t
  misc_feature (769)..(769): n is a, c, g, or t
taactgggtatgtcctatatattttttcctaaatctcacaattctatccacactgcctttctatctttttcagctgggctatctataaggggcgagatctacctccctccatacccttgtgttcagacaccttatgaatatctgcagtcataatgtccttcaagaaagaaaacattggtcagctctaggtcctgcaaatgcgttttgaaggacgaactcaaatacagatgggataatcaagtaaatatcttcataggatcaatgccaccatgttcaacacttccctttgccagcctgttgtgaggtccaagtttccccattaatcccttatatagcatttcccagtaactgggacaaccaaaaacacaccgacatattagaaatgctcctgaaaagtggcaacaccgcctaactcagtaccaggacctcttttaaattcaatttcttttttctttcagagagataacaaacgaattcattatttcccccattcacatcttaccacaaattatttttatcaggttaaaactggtcatctacggaattgtagaaaggtgacataggaactgtcttcactgctggaagaataaaagagtctgaggtatagacactgccctggtgacaccttctcagaacattgttgggggacaggggaggcaggcgcaagtaggggatagaatctgaccctgacatgcagctatcacctggcagagagactcgtcaaagcaaattataacgaccagtactaggntgaaacccaaagccnaanaagacgggcaacgggtggcctaacctgcaataaccgggttccattgctcaaacggcccgagctaaagagcacggggtcagccctccaaagg

SEQ ID NO: 1685 - DNA, 317 bp, Homo sapiens
tgtgtgtgtgtgtattttaagttctttacactgtactgccaacttttctataagattctagttcctggaaaaatatttttttaaaatcattcattaaataccaatttctctgaccttccttttaccaagactttctcacaggaatgacatgtggttctatggaaagaaccccaaactaaacatcaggaggcttgggttcaaatcccaggtagatcccttacttgttatgggattaggacaagccatttaacctttcggcttcctcctctgtcaagatatatacctgccctgctcatctcaaaagttgtttcagggat

SEQ ID NO: 1686 - DNA, 486 bp, Homo sapiens
gattatattgaaagttcttttctgtttagcctgagctgcatctgactaatctgcttctctttcctcttaccagtaaaggccatcatgatgcctctcatgttgactaaaaataatgatgacctccaatgggtcatccttctccaggccccagagcactttccaaggcttccctgtgctgctgagtacagcacctttcctccaattcccatctctgctgagtcatcttccagctttccagatggaaaggggccaggcaggctgcaggccagaagtcaggacttaaagcaggaagccatgggagcactgcaaccttctgcaagtgtgcctggagaagagctgccacctttgtggcacatggccttcagagggagagactgcaaccctgaccctcttatagcaggactttagactagtgccatccagtggaaatataacacaagttatgtatacagttttaaattcttcagtaactgtattttaaaaagt

SEQ ID NO: 1687 - DNA, 1130 bp, Homo sapiens
gcacgagagttgcttcccacatactctgtctcaaagtgcctgatagagtggtgggggataggggcctgttaacagcagaattctccatcgttattgtgttcagttgagtctactctcatcttctgtgaatatgaaggaccttggtaggggtctgctgggtatgcacttgtttgtgtttgcaaaaacacacactcttgtaatgcagtcgacccttggactgagcagggattgttagtatggcagagttctcaaggtatagtgaatttaaatcatttctgtgaataaatggttgaatagggtgaacgtgatttttttgttatttttaaaaagttactattacacaacactgaggaacttggaaatggcacaggcactgttgcagattttttggactggagagagagatagtaatttaaaaaaaaaagaaaagaaaactttcaaaatgttcttattgaaacctggcacccatttttcttaataggagcatccttagatgggtgagtataagaggaatgggagcttttatattgtttgttttcacatcattagcagcttaccttcttgtgaagataattaaatgccgtgctcctacggaagcactcatacataatgcagcaaggagagcgggagtcccactagcttcccaccagtttccccagttcagaagttatacacttgatattttccgctgttgacaagttttctggtttgcccacacggagttatctgtagaattatctgtattatgtttctaattaagtattgagaccctgaaattacattttgatttgttctttattgagccagaaggatctagtcagaacttctgagtgatggcagcagagactgtaaagccatttccagcattgtgcagaagtacaagctttagggtgtatctattcatctattcctagtacataaaatttagccttacaaaaagatgacattgttttatgtattttttaatgtgtgcctttaaaaagatttaaaaagtagagataatttaagggtgtttataaattatggggtgctgtctggagaaggacaaatcaataaatgcttattgaacacctattgatgttgatgacgtttgttatcttgtggggtggcagcatgctggtgtgttttgt

SEQ ID NO: 1688 - DNA, 365 bp, Homo sapiens
tcaacatgtttctacttaagaaggcagggaagtgtataataaattctagaaacatttccacccaataatggtcaaagagaagagattcttagtgtttaaatctgtgaactcatacctgtctataaaacataccagtttttagtattttgaaggtttggggtttttttttaactataaatttgttattatctatgcctattttatagcccctggaagatactgctactattatcaataacgtggaagaaatgatgtctttccttttatgacataactgtgagtcctatcaaggacagaatctttgattgaaccagtatcctaagggaactctggtgctctcagaacaagctattttatgacattgc

SEQ ID NO: 1689 - DNA, 492 bp, Homo sapiens
aaattcctgttgaatttcaataggaatgaagagattaccaaatcattttcactctggattctatttttgtttttattggcaatgtctcccagctttgtgtcatctgcatccttcatatgttttgatctccggcattgatgcaatctgaataaaaaggaaagccaacagaaaaaaaattacatcaatttacttctgccctcccatcagtttgatagtaagttattaacaaaaattcattgagtattctgataccactagttttgcatgcaaacaaaatgtcaccatcttatctcaaaggaggtcatttgaattacttttttgaaagtaaaatatacctttattatgttctcacctgatataccaggctttctgctatttaaaaagtatatgttcacacattcttagataatatatgttgattcttagtgcctatagtttctaaattttcttaaaaatcattaaataaaaaatgtctatttttttccatggtta

SEQ ID NO: 1690 - DNA, 3681 bp, Homo sapiens
  misc_feature (1310)..(1310): n is a, c, g, or t
gcagcgggccagcgcccgcagacacactggcatctcaagagggagtgaggagaggattgcagggacttttccctgcgaaacaaatgagacaatgacataaacggctcttttatttatgaaggccctgggagcagcgttaagggctccaggatccagctctctttgcatttggtctgtcggaagctgtcctcgtgctttcctggaccgggagagtcccggtcccctcgggagggactccaccgcctctcacactccgatttctgctgctctgctgccccgcagtcttttccctttatttgcttccccctcctcccctcggcctccaggaagccaccgtggccggccaagcacaagctcacccactttggagcagcatttctcctccccagaggacctcgaaggctgcaacggccctgccccaagccccagaaaaagaaactcttggagggagtctgcgggcttctctgagaaggggcgcagcctgacacctgtgctgtccctgcagtctctaggcctgtctgagctgctcccgtgaccgtgtcctgagtggccacctcctccttgggagggaggccgcggcaggtactctccctttgctgcttgctggcggccttgctagggctagaaagttttctcagcgttgggggaggggctagcgttcttgtccaaagcactcatcctgctgcagggaagggagctgtacggaggctggaagctgcagggttaggcccgagagagcttttgacaagcctggctcttcctgcttcccacctttttggctgaatacctttgggtcctggaggctgccaagggcgcttcgccttgagcaggtcccggagaggctcagcctgcccctcctgggggccagcctccttgcctctgctctgacctcagcagctacacctaaccccaccgcaccctacccagtgtcgatatccacaacccagcccccaggcctgcacgttggagatttctggatccttccctgggagggagaggtctcctaactcgattggacaggagccttcattccttgactcgtgtcatttgggagctatttatttattcttagtatttaatttttaacatcctctcagggaccaggggcctcctgcttttcagaggcccgagtgcatttatcccaaaacgaggcatcttgacatcccctatccccaccccctaaattcccaaggccctaaggtccctcacctggttgctctggaagctcttgctgataggaatgatagcaacactgaaagagcgtgggaaggtggagggtgtcaccagacccacacagagcaagggagatnaaggcagttcttgctgccccttctctggctgtgctttgcctgagggaagagttggcaagaggccagaattctagtttggtttatggggcctggattctggcttgaagaagccatatttggcatgggtgaagtgaaagggccaggaggttctggaggccccttcacttccagtcccatagcggggctcagctatttttctgatcttattcaactttagttgtgcaaaagaaattctaagtgaatgcgcgtatgacaggtcaacgtattaggaaggagccagaaagtattcatactgctactccttatgagatagccaagaagcatcatgtcagtaactgggagtggagagggagttttgttttgaaactatgcaggtatttttcagcatccatttgtacattagtatggttctacaggaccccagctgtggaagtaacaaatttcttctccctccagactcttggatgactacctagatccccagcttaccggttagtttcctccacaggcttccatgagctcagtgtcccaagacagcaaaaatctggtataccctgtagaagcaggggggtagcaaatttaggctctcttcgaaattacttgtacaatacgagtgccttcgcagcttagccccaaagtgctacttatgtttcccaaggtcttttctattcaaatcatatttggtttcaggcccctttatgggcatacggtaacagaaacctccatcattcatatgagacccttttgtcagtggtaacatcttgtacttggaaaaaaaatttttttttttttttttttttttttttgagacagagtctcattctgtcgcccaggctggagtgcagtggtgtgatcttggctcactgcaacctccgcctcttgggttaaaagaattctcctgcctcagcctcctgagtagctgggattataggcacacaccaccacacccagctaatctttttgtattttttttttagtagagacagggtttcgccatgtcggccaggctggtcttgaactcctgacctcaggtggtccacccgcctcggcctcccaaagtgctggcattacaggcgtgaaccaccgtgcctggccggaagtctttaaaaaataaagtgattctactcttctaagcttacagagaccagaccaggtgaatgtaactggggaaaatcaagatggtacctctctgcattatcccgccagacactgtattttatgcattcatgtctaggatacagtgtgaaaattaaaaagtttagagggcagatgcaattgtggcaagtgacctgccaataaagcaggtgcagctatagaagctggcataggtatatccttaatggtgctttctccctgggcttgtctttttgttgtttttttccccctatattcagagctccttgagaagtgataaacacctccagctttctaacatcctccccacaccatctcaccatatccatctcccagcatccatctgcattcagctaagggcgggaaactgacctagtgcctgtgttgcagaccatttctgaggtctccaccatccaaggaggcacagccgtcattactgtcctccatgccttcagcagcccccctcacagctaaggtacataccaccccttctgccgcgcctccacccctggcaccaaggtcttctgctgcttatgtctaaagggatcacctatatttaactgcctcagtgacctaacctctttcttctcatgtgccagatgttaagatgaaggaggaatacaacacatactcaagcctcagcctgtttagttgttttcactggggctcgcttttctgggacggtatttattatcagactggcaagcctaactccataggtttacaggaagtagggatatttttataaaacaattgtgtcctccccacattttgctatgttaatatttgcttctaacaatttgcagctgtttcactttttcctcatttgtctctaagttgaaggctttgttggaggggacagagcacaggaacagccttgacagtctgtaattattgtacagatattttaatagcatataaataagtatattccttttattttgaaacaaaaatgatcagacactgccttttgtgtgtttgctgcctgtggcatccttttttaaaaagactgttacatattaaaatagtgtacatatataaatattacctcttttgctgtacagttgtgatagagactgaagattttattttttgtgtgctttttataagaaaaaaattaatacactaaagaatcttgctgatgtgattgtaatgtacctatgtaacttatttacttttgaatgttcttctgtatctttaaaccttttattaaataaggttttaaaaattcaaaaat

SEQ ID NO: 1691 - DNA, 430 bp, Homo sapiens
tcccttcttttactcttcttctccttctccttcttctcttctctcttattcttctccttctcctccttcttctttttttctttttttccagacacagtcttgtcttcctctgtcacccaggctggactgcagtggcatgatcgtagctcactgcaaccctgaactcccaggctcaaccaatcctcctacctctccagagtagctgggactaaaggcatgtgccaccatgcccagctatttttttggatttttagtaaggacaaggtctcactatgttgccaaggcaggtcttctttgtccttcctaaagaatacagttctggtatttactacttttccaaggatagcctccttactttggctcatgatcatgtttttgtcagcaactacagctccatctttaaaccctctttccccttgaatttttagtc

SEQ ID NO: 1692 - DNA, 305 bp, Homo sapiens
ttttttcagttaaatgtttctacttattacaatgaattatagttacaacttctatctggctttggatatatccacttctgaactctaagttatgttttgttatgcagtaactttattaaccaaaaacaggaaaaaaaaaagtctgatacataataatctgccccattcattagaaattgaggacttgttttggaaacagcttttgaggttcacctaggtagctaattagtcatcagccttgtactatgatcgataggcagggctatgaaacttcttcccctaagagcactgacttcgggggttac

SEQ ID NO: 1693 - DNA, 341 bp, Homo sapiens
ctgacccaaggtagtctaatgatagagacacctggatggccccaggcatactaatggaagagactcctggctgacaccaagcattctaatgatagagacaactgatcaaccctaggcattgaaatggaagagactccttctcgaacccaagcattctaataatagagacagctaatcaactacaggcattttggagaaactcccgatcaaccacagacattctaataatagagacacctgggcgaccacaggcattccaatgggagagactcctggccaacaccaggtggtctaattatagagacacctgggtgaccccacgcattcaaatgggagagact

SEQ ID NO: 1694 - DNA, 190 bp, Homo sapiens
tttaaccaaattcacctttaccaagggctattcaatccatatctgggatgttttaaataaaactatccaggactgtgggcaatattcaaagttaatatttgttgccaatatgtttggagtgcaagataaagcattataatgtctagacatttttgaaataaaaaagtcttctggttaccaaaaggcatta

SEQ ID NO: 1695 - DNA, 409 bp, Homo sapiens
gtgtgggatgctcttccgtgaaactttgtcctgttttgtaaggaaagtcattttgagtttgaaatgctcttaaactatagtttataattggaacacttaatcattctggggaattctttcctggctaataatctctcaagatggttgagaagtggaaaaaccataagacttaggcctaactcattattttgatggtggtggttcacgtggaagcctgtagcttcccttggttgtttgtgtggaatccatgtacattccccaaggtggttctgtgctgtctagttattgctcctgcttggtattgtgtgtctcctatgtgtgtgttattaataacattgattaaaacatataatggctttcttgtgaataagcacagtcaaatctaaaattgtaaaccatttgaagattt

SEQ ID NO: 1696 - DNA, 861 bp, Homo sapiens
tagaacatttgctgtcagccacatattgagatgacactaggtgcaatagcagggatagattttgttggtgagtggtctcatgccttgagatctgtggtggtctttaaaatggtggccagccagatcaaggatgtagtatctcatagttccggactaaatactggctttccactttaggtgatatttttcttattagaaaaatattataactcatttattgtttgacaattatagattgaaatttcctaattctaaattttaagtggttcttcagtttcagtgctttatgttgtttgttgttggtttggcatggcattacatattatatgttctagaaacatgtaatcctaaatttaccctcttgaatatgatccctggatgatatttttatcataaatgcagaataatcaaatatattttaagcaagtaagtgtcctccatcagttctgtattccagacatgggaagatgtacagttgctgttgtgtgatcaagcatgtctctgtgtagttccagcaaatcaagctgagctttgaaaaagtttgagtcttagttttgtgaaagtggtttattctcaaaaaaaaaaaaaaagaaaaagaaaaagaaaaaagataagaagaaggagtaaagggactactcctccttgccaaatgtgctaaatatcattttaggagaagaaagtggatttattgtatttcccttaagattgtgagggagtgtggatacagtagaacgagccaacagtttctttataataaatacggtctgcaataaattatttcactagctgtaaaacctttccctagattttagtagggagttggtttctgttaatatctttggtgctgtggtggtaaatgct

SEQ ID NO: 1697 - DNA, 603 bp, Homo sapiens
  misc_feature (556)..(556): n is a, c, g, or t
  misc_feature (561)..(561): n is a, c, g, or t
tagaacatttgctgtcagccacatattgagatgacactaggtgcaatagcagggatagattttgttggtgagtggtctcatgccttgagatctgtggtggtctttaaaatggtggccagccagatcaaggatgtagtatctcatagttccggactaaatactggctttccactttaggtgatatttttcttattagaaaaatattataactcatttattgtttgacaattatagattgaaatttcctaattctaaattttaagtggttcttcagtttcagtgctttatgttgtttgttgttggtttggcatggcattacatattatatgttctagaaacatgtaatcctaaatttaccctcttgaatatgatccctggatgatatttttatcataaatgcagaataatcaaatatattttaagcaagtaagtgtcctccatcagttctgtattccagacatgggaagatgtacagttgctgttgtgtgatcaagcatgtctctgtgtagttccagcaaaactaagactcaaactttttcaaagctcagcttgattngctgncgacgcggccgcgaatttagtaatagtagtcgacccgggaat

SEQ ID NO: 1698 - DNA, 1819 bp, Homo sapiens
aatctcgctctgtcactcaggctggagtacagtggcgtgatcatagctcactgcagcctcggtctcctagggtcaggtgatcctcccatcttagcctcctgagtagctgggcatgtgccaccacacctggctactttttaaatttttttttttctgtagagacgaggtctttctatgctgttcaggctgaacttcatgggtttattggggatggctaatggatgacattggcggtggtccttgataccagataagccctcagtgtgaagcagctcttatttttccttgtcttgagattgctctggaatggaaattaggcttttttgaaggtgtgaccctttttgttcatttcttcagcagttactttttattttttaaatgtttgacacacagtctctgataaatgatcattcaccaatcaccgattactctccttgctctgttaagtgtgacactgtccctttgagaatctggcgacagctatgtatcccatcaccacacaccccaaaaaaaaaatttatgtctggttccaggagttaccttttatgagaagtccatctgtgaagaccctggatgttcagagaacttcctgggaaaacactgaaagaaaataaagaggccgggcccggtggctcatgcttgtaatcccagcactttgggaggctgaggtgggcagataagctgaggtcaggagttccagaccagcctggccaacgtggcgaaaccccatctactaaaaatacaaaaattagctgggcgtcgtggcgcatgcctgtagttgcagctacttgggaggctgaggcaggagaattgcttgaacccgggaggcagaggttgcagtgaaccaagatcatgctagtacactccagcctgggcaacagagtgagactccatctcaaaaataacaataaataaaacaaaataaaataaatacaatttctgtttctagcccctaagtggtagcactgggtcttgttccctgaaaaaaactaggctcagaatccactctcatttcatctcccctgatttgatctgaaaagattttgtttagagtactacatgaatatattataaaacatgggacaatcagaattgatagtaagaaggcaagtggctctatttgtacttcctctcaatagctcctaaaggtaatgctaccattttctgtttgtacatagtcttccagactttaaatttttgaacatataaatattatcatcttaaagacgtatggaaaaaaccattttgaataggttattccaaaatgtaatttaacagattgctctggaggattgtttgtttgtttgtttgttttggagacagagtcccgcttggttgctcaggctgcagtgcagtggcacaaacacagctcactgcaacctctaactcctgcaaacacagctcactgcaacctctaactcctgcaaacacagctcactgcaacctctaactcctgcaaacacagctcactgcaacctctaactcctgcaaacacagctcactgcaacctctaactcctgggctcaagcagtcctttcacctcagcctcctgagtagctggaccatgacacctacctaactttttattttttgtaaagaggggaatcactatgttgcccaggctggtctcaaactcctgggctcaagcaatccttcctcagcctctcaaagagttgggtttacaggcgtgagccaccgcacctggctcctggagcatttctgatgtgaacatgtgctgatctaacaccactccttttaccagctgcctgttctagagcaaaccatcttttttgagcattccactttggctaggccctta

SEQ ID NO: 1699 - DNA, 1934 bp, Homo sapiens
tgcatttctaacagcaatgaatgagagttcctgttgctccacatccccaccagcatttggtggtgtagtgttttgaattttggctattctaataggtgtgtagtgctaccgcattgttttaatttgctgtccctaatggtatatgatgttggtcatcttttcctatgcatatttgctatctgtatatattttttggtaaggtgtctgttaagattttttccctttttaaaataggatttttttttattgttgaatttaaagagttctttgtatattttggatacatgtcctctatcagatatatgttatgcagtattttttcccagtgtgtggcttgtcttttcattctcttaacaatgtcttttgcagagcagaagtttttaattttaatgatgtccagcttatcagttttttctttcatgagtcatgcctttggtgttgtatctaaaaactcaatgctagaccatggtcacttagattttcttgtatgttatcttctagaagttttatgttttgcattttacatttatgtctgtgatccattttgaggtaatttttgtaaaagatgtgaggtccatgtctagatttttatattttattttattttgttttgcacgtcaatgtacagttgttccagtactatttgttgaaaagaccgtccttttcccattggatcgcctttgcttctttgtgaaagattagttgaatatatttgtgtgggtctgtttctggactcttgtgttaatttgctatagcttctattagaaagtaccacagactaggtggcttatacagtggaaatttattttctcggttctggaggctagaagtctgagatcaaggtctcaatagatttggttcttctgaggcctcactctttggcttatagttggctgttttctcctggtgtctatacatggtctttcctctgtttccaaacatgaggagtttgggattgtaatttggagtcagatatatagcagagaactaggggagataaggactgggagaagactatcgagtctagttaggagggtataattgctgttcagaaagagtagttggtaaagcatcctaattagaaatgattgagaaggcaggaggaaatggtgacattgtctgtggtctcttttcaaggagtttgatcatgctgctttcttctagtaccatagcatttctatcttagtgtttttctcaggagtatttattgagcacccatgctgagctgtgtaccatggctgacagaggatgaacagaatgtaatccctcttctcaagttggtggcagactagatacgggaatagtatggagtaattatagcgttaagtaatatggggtattttgtgattaagtattgtgtaattcccaataaaagttcagaagatcagaaaaaatgcagcccatggccaaataaaggctttttagaagagatagaatgaaagtttggctttaatgtgttgtttagatttaaatggataaagtggaagggcactgtagttgaggtgaaaatcgaagaatgaagtcctggtagggggaggaataagcaagaagagatcatgcaggaaacgggccaaactacatcaaatgatttgtattggagaataatagagaacattagatattaataacaatagttataatcatagcagatgccatttatagagtatatactatgtactaggccttattttatttaagtgctttataggtattctcattttaattctcttcacaaccttacgaggtaggtattgttatttccattttacagatacagaaactgagacacaaaaagaaaggtcaagaataggcccaggtcaggtgcagtggctcacctctggaataccagcactttgggaggcccatgtgggtggatcgcttgaaaccaggaattcaagaccagggtgggcaacatggcaaaaccctgtctctac

SEQ ID NO: 1700 - DNA, 464 bp, Homo sapiens
tctcccctatctcatgatggcatagacgatttttccatttctaaaacaatctgacatttcttttctagtgtaaggacgttatcatgttaaaataaacttttacaaacacccccaaacctgcccattgccccagtctgatttaatctaaccacttccttcatccccttgcagcttgcataactaaacaccatcacttccccttttttacacattttactcccttgaccttccccttctccattcatctcttcctagcttatttttctttgccattcataatacctactgtcaatctgtctttttgcaaacattctttttgcccctttgtcttttggttgtacccatctggaaatccacagtcctataacaaattcagatatccattatctctacgatcagatcatcatagcaactgcctggctggaattgaggatccagttgaagcagtaggttgagaacataca

SEQ ID NO: 1701 - DNA, 344 bp, Homo sapiens
acaggactctcttggagaggagctaactactttcctctctcttaatacccagaccctctccctcagccctgacagcacgttacagaatgcattcacttagtgtgtgaagagctcaccacctccctttaagatctattcttgttattcatacattgcaaatttgtacttttgtatccacaaggaagacattactaacttcaagaaaggcagtgtcaatgaggagcaggaaaatacagtatgatacaagcctgccaatgaaagaattatactcagactctatgcgctctaactgttaaacaaaatttgaacctttgaggaaaaaatattggggattctgatgagtg

SEQ ID NO: 1702 - DNA, 365 bp, Homo sapiens
taacctgagttgcaagatgaatttaccacacagtgacagactttaaatttttggttttaatacacatttgcgtattttaaaagcaaatgtaccttcagcctgtgaaataatatgctagataattacaggtactttgacttcagttatgtcttagatttattataactacagtgttgattactacgaagacattgctttgcagagggagatgtctcaaaatgtcacaattcagtgttttattatcagacagttgctaaagtggatagttaaaaattgaggcctggcatggtggctcacacttgtaatccctgtactttgggaggatgaggcaggcggatcacttgaggtcaggagttcaataccag

SEQ ID NO: 1703 - DNA, 353 bp, Homo sapiens
ccattgcactccagcctgggggacagagcaagactccatcttggaaaaaaaaaattcagatttctagcacctaccctctgagattcagattcagctggtttggcttgatgctagaaagccgcatttttaggaagcaccgcagatactggtgctccacgagactcactggttggttagaagtatagattctggagtcatgaagcctggttaagttcagtatttgctttgccacttatccactgtaaatccttggccaagttatttagcatctcttaatttcttcctctggcttgtatcttgtgagaactaaccaagataattcaaataaacatgtggtacacttatttgtgata

SEQ ID NO: 1704 - DNA, 220 bp, Homo sapiens
ttggagacatgattaagaagtaagaagagatgctataatcatgacatttctgtgaccatcagagaaagagaggaagtggggagaagtttgggggaagcctgggtgacgggcaggaatgctgagctgtgggctggaggctgcttggggcatcagacacctctctcctttctccctgatgcggcactttccttaatgtgcctctgaaaccatcaagagccat

SEQ ID NO: 1705 - DNA, 469 bp, Homo sapiens
ttttgaagtgatcaaactaaaagagaaaacaaagctcatggctgaagtcatcacacctgaataccatcttgtgatgtcatggttttattggtatgaattctaaccaagctgtgggcatttaagtcatatttgtggatcagaagccatagatatttgcgcttctcataggctgtgcttttctgatactttgatcattattatatggtaactaacatatattaatatattaatgtattatatcatatttatttagaccccagtatggatactaaatgggataaagcatatgccaagattttttaggtcttgggattatttaatttttttagaactggcgttcattgattgtcattcacgtttctcttcacttccttatgaaaagtttctcaactcttctctcagtattttcttttcccctgtgagatatgtttccttttacactttttcattcctctaccaaatagtaata

SEQ ID NO: 1706 - DNA, 1508 bp, Homo sapiens
caggcctggaggagaaatgacatctctcagccctctcagctgcaccggaccaccaacagttgtgattcaatgggcatgaattgctgtgtgatgctggggaggtgtttgtgattcttgacaaagtcatttgaatccatcacttcaagagagtgaaaggagccccgtctgatctgttggtgttgtaggaagaaacatgagtcagcaaaacaccagtggggactgcctgtttgacggtgtcaacgagctgatgaaaaccctacagtttgcagtccacatccccaccttcgtcctgggcctgctcctcaacctgctggccatccatggcttcagcaccttccttaagaacaggtggcccgattatgctgccacctccatctacatgatcaacctggcagtctttgacctgctgctggtgctctccctcccattcaagatggtcctgtcccaggtacagtcccccttcccgtccctgtgcaccctggtggagtgcctttacttcgtcagcatgtacggaagcgtcttcaccatctgcttcatcagcatggaccggttcttggccatccgttacccgctactggtgagccacctccggtcccccaggaagatctttgggatctgctgcaccatctgggtcctggtgtggaccggaagcatccctatctacagtttccatgggaaagtggaaaaatacatgtgcttccacaacatgtctgatgatacctggagcgccaaggtcttcttcccgctggaggtgtttggcttcctccttcccatgggcatcatgggcttctgctgctccaggagcatccacatcctgctgggccgccgagaccacacccaggactgggtgcagcagaaagcctgcatctacagcatcgcagccagcctggctgtcttcgtggtctccttcctcccagtccacctggggttcttcctgcagttcctggtgagaaacagctttatcgtagagtgcagagccaagcagagcatcagcttcttcttgcaattgtccatgtgtttctccaatgtcaactgctgcctggatgttttctgctactactttgtcatcaaagaattccgcatgaacatcagggcccaccggccttccagggtccagctggtcctgcaggacaccacgatctcccggggctaacggaaggacatcctgttcaggggaagaaagccctggccctgaattctggtaacggatatcgcgttccagggttttgatgtggtgggatgatccgcaccatcttcactgatgtgcttccctttgatgcccattgagtgccagctttgctcattataccccaaagaccttttttccactgcccagacagcttataccacccagtgttcagggatctctgaagaacccacagaccaggtgaattactgatttctaagtccaaaaactatagagcagaagaattgagaaagagaatgagaccatgtcaacaaggctgtttccaactctccccattttcctgttctactgggaggttctg

SEQ ID NO: 1707 - DNA, 360 bp, Homo sapiens
gagtctcttttttttcattttgacactttcaaaattgagatgtatcttacggttgctgtgatcatttgaagaagtacttactgttttgctccctataaagctattattaaattgatggtatatcttaaaattattggtgtccttgaataaaggaactatggtaagccatgtgttttatttaaaaaatatagctacatagtttatagaaatatcatagtaaatcacagctttaacatggggtatacaaacaatcccaatttatttatgaagtgggaaaaatgtaaattaagattatattaacaatctatatgaacactgatattgcttaggtaatgatctaaatgtgagaagagaataaat

SEQ ID NO: 1708 - DNA, 1045 bp, Homo sapiens
gggagggaaggaggaaagagacagaaagaaaatggggagagaatagcaattacaacaatgagagagaattggataagggagaaaaagaaatgatcaaaaataaaaggacagaaaaaggttctactgaagtagagtcattgactgcattgggatacttgaaaattatttagtgcttattgcttagttcgagttcaatctgatttaaaaagtttatgagattctggatgagttgggaagagctattttgcactttgacttgatagtgatgagtgcccagaaacgttgagatgtgggccccaaaaggaaatgattctacttatgaaaaagaaacatcccgttgttttgtttcataggtcttaaccttatttttaatactctcaacatacctgtatagaatgtttatagatttttctctctaaaatttctcatatgattccagtacattatttttagttttaagttgaattctgagggtagcaccctaggatttttgcctcattttgaacctggaagtctacttgattgagcagataaatagggggaaataggaattcatccttagtgaatgaatgtgtagacagctgatatttaaaatttagctttaggttcatgtcatatgctaactctagaaaatggagcctggcaaagttttggattctgtctgctaagagggttctgggctcaaaggtccctgctgtcagtctgtagtctgaaaaggatacgtgttgccatgtaaactggctgggcagtatggattgccctctggggatcctgactcattggctctaattcacgtggtgcatgtcaatcagctgctccctgtggttgtggccagagggccgccataatttctccgggtcaatggtagaaaattgattttcttatgtatactgctaccagaaaatgaaacatttgctttccatgtaatgcaatattttatctgtacctggtttggttcaggagtcaatgtatatacatgcttaaatgaaaacaactcttcgtcttcccctgtcactttttattgtgaaaattttcatacatgaaa

SEQ ID NO: 1709 - DNA, 452 bp, Homo sapiens
gatccgccaggcaaaactgaaatgacattttaacactaccacctataaaataaaagcaggaaggtaaatctgactgaaatcaaatctagtaattattttaaaggtaatattccaaagccaaaacaaaactgtggggaatgggagaggtctttgtttctttctgatagatgatttaaaatgatctgctattagggacacttcatcccttagatgacctatggggtcccctgcgttactaacaaacagcagcaagcgatcagtatctaactccgtgtcactctctgagagcactgtggcatcaagaaaggtgtcccaggagacctggcctaggcgccctctctgtcgccaagttaattgcatggccttgggcaagtcactccaccccgaaagcctcagtgtgtccatctgcagaatggggctgccacctcctctcacctgatgttatggagatg

SEQ ID NO: 1710 - DNA, 442 bp, Homo sapiens
atacagccttggaaaccaaataaaccacctgctatgtcttctccagattccctttctcactccccacctctccagactattcatttatatggacaaaccccttctctcctcactttctggtgaataattacttattaacacctgcaaatagttccaaataactggtagagaatcctaggatccaaatatctgtagtgaaatatctatctcgggttgatttccctgcctccaatgaggtctacctataagctgagcccatataatgaaagaagctttaataattcttcaggataaaggtgtgtgtgcacccatggatttaaatttaatagtttttttgtttggtgttctatctatgcttaggaaataaggacaatccttagtattattccttttgttactgagattttttggtctaactttaaaagaggggctgccatatgca

SEQ ID NO: 1711 - DNA, 431 bp, Homo sapiens
gctaggataccatggtaccttgataagaattccagattcaaacaacagaaacaaaagtgacacagtagtccccctcttgggcagtcttcaagcacatcttgaagagttatatagttggtctttgaatatcactgccttttggctgtttcttcgatttatataaaagaggccaatttgaagccattcactcagtactgtatcactcacatctgttgtaaaaggcattagaatctgtggagtgaggaaaaaacagagcctttatgaaatgtgcgcttgaaatgagagatgtttgtcttaaatttggacaggataaataagagacttacatggaaactttggaagctgttttagtgaaatttgcccttaaggtcttgtcttattccaaaatgatgaggcagaatgcccaaatgttagcatttgacatgtgaaga

SEQ ID NO: 1712 - DNA, 361 bp, Homo sapiens
taaaaaacgggtttcgactctccagctcttccaggccaatgtggatttctagcttcttgagaatggttgatttagcttcccaagacctcagtggttttatgaaataccgcctcatttctccagaatgatttctacttaacaaaacacctccatgcactgtttaccgtgctcattgtgggaactgctctgatggggggatcagtccccatgatgtcacctcatgactcctgggtcacacagccgctatagatggtggcttgtctgcagaaagggtcccagttgagttttgttttgttcaatttcagtaaccatgcttgtatcacagtggggcccagtggctcctaaggtgagccttctcatt

SEQ ID NO: 1713 - DNA, 501 bp, Homo sapiens
aagacagagtctcacggccacccaggctggagtgcaatggcgtaatcttagctcactgcaacctccgcctcctgggtcaagcgattctcaggcctcagcctcctgagtagctgggattataggcacctgaaaccacacatggctaaattttgttttgtatttttagtagagatggagtttcaccattttggccaggctggtctcgaactcctggcctctagttacctacctgcctcctaaagtgctgggattacaggtgctctactaaacatcagaagcttcttgttcttgggtttggtttactcatcaaagaaggggtggcatgcattatatgttgtgaaattttctaagttctaatatcatattctaaaaatatatagaaactatttcagaatgttaagactataatactaaaatgacccctaatcctgccactcaaatgcacaactacttccattgttgaactaatgcctttaaggcgcttgcttttctgtagcacac

SEQ ID NO: 1714 - DNA, 363 bp, Homo sapiens
gccaaaaagcatttgaatagatgctgtactatactaataatcaaagaaacacacattgaaataagaatgcaagttcctttttttgctatacaaaatgcaaagttatctagtattgataactatggggatcaaacattcatatactgctaaggttaaatgggtataattttcttgagataaatttggcaatgtatttcaaaattttaaacgtgcatgctcttagggttatgctcccaagtgtgtaggtacaaatgatgcatggtgcatcaattattttgtcttggaatttttcctatgcaaatagttagatcagtaactcaagatatatgaacaggaatattcattgatgctttatttataagt

SEQ ID NO: 1715 - DNA, 334 bp, Homo sapiens
attttagtcattgtccattattttggtaaattggattcctcaaaagtgaagaccttttgaaactatgagcctggaaaagaggaccttttaattaagagcattctgctttgatgacattttcttctaaatgaacaataaggcctatggttagcttggagatagcaagtactcgaaattttttgctattttgaataaagcactatcaacttaatgaggttttactgcacatactgttttgtcatttgaaaatctgaaagcacacaaaaaaagtcatcattagcctcacagatcctcatgtgcaatagctttccctgaatgtttttaaaggatgtat

SEQ ID NO: 1716 - DNA, 589 bp, Homo sapiens
atgcccctttcttctaagttaattgcagaagaaagttgtttaaataataaaaaggtcaaacacaattagtaaatattctattgctcaaattccatgatctaattatatacagtacctaattaaggttattatgagaactatgttacacacttattcttaagagatgcatttctgttagatattcccaggagagtttccaaggtggcagttctagaaagagaacagtatgagaatgaaaacaaaagggctagacacatttctaaaaagtagtggaaaatggcagtctatcattcttccattccattgttattccttccccaaagacttacctatcccttgaggaatttaacaagggttgccaagggtgagaaaagtatgtacattccagttaatactataacttatacaagaatatttataactttatatattctaaaaccattgaattttaaagctgagagagtgctcattgtttatctggagttacttccagttactgtagaaatctgtttaatcaaaggaatggctgttactttgtgatacgatttatttcattttttgacagctgtagttgttacaaagtgcttct

SEQ ID NO: 1717 - DNA, 602 bp, Homo sapiens
acgtgactcagttctggtcaccaaggtggtggaagagaagttctcttgaggggcatctgggaaagattcttctgcctgataaaacaggaggtaagcaagggttctgctcccccatttgtttctgcctttgaacgtggctgtgggaagacatgatgcttagtgttgctgcagctatctcatgaccttgggcaaaacatcccaacacacaggagggccaaacaagcagtcagaagaagcctgagtcttgtgggtgttgttgagcagctgaacaaaccctaggatggcttccttccagacttcttaggattgcgaacaatgaagctctattgtttaagcaaggtatcgatggctattttcacttgccactgaaagcaccaggacagagaatcgtctttctaggaatacagccacaaaagccttcattatggtatatgcacataaagaatataaaagtttcctttatgtttctctttaaaatatagctgaagtctgcctcaggcaaaaagacaaacagaaaacataaatgcatacataattcaagaacaataaatatttattttaaaatgaataaatgttctgcaggatattgtaaagttttctca

SEQ ID NO: 1718 - DNA, 344 bp, Homo sapiens
cacttgccctgttatgctttcatctcccttgggaagggtttgtttttgaccagtgttgtggctttctagatggacccgttattatgaatgtgagtcctgtttcttttacttttcatattacgtgtacaatgtagttgagaattttcattgataaagcttttcagacaaaccattcagcatacatgtttttctcatttacattttcattcatgataagccagaaaatcaggctggggtggtggctaacacctgtaatcccagaactttgggaggttgaggtgggcagatccattgagccaaggagttcaagaccagcctgggcaacatggggaaacctcgtgtct

SEQ ID NO: 1719 - DNA, 449 bp, Homo sapiens
cacaaacttccagggtggagaagggaaggtgaggggagcctctgagcctctcctaaaagtgcttcctattttcctttctcacaaaagatataatagaaagaaacttcaaccccaaagcaggcaattagtgatgaggaagtactttccaacagccaggagcgtgaggctgagaagctggagttaagttggtggagtgctgcagggcagaggggctgctccaggagacctccagagccctggggtctctgtggggctcgattgcccccctgtctacccattggctcacatccaggtggctgggggctcccaggaggtaagaaggcggactagagcccccagcaggccagctgagttgggggcggatgctggcttcctgtctgatcggctactgttttactccattcttcagactgctcaaggaaaattgcctccctaattggctcttctct

SEQ ID NO: 1720 - DNA, 424 bp, Homo sapiens
aaatattcagtaaatgttaactactattattaaggcaaaatacagaaaagcaattagtaggctaaatttactactcagtagttagggacaaccataaacttaatgtactaaaaagtctttaaaatttaggtatatcagaaagaaaagttagaccttaaaacatgagggcttatgctgctgcaatgcctcctggtagaacatagaactatcaagagctagacatatgctccttatggtcccaggatcataatattatataacaatgaatgaacgcccaaactggcacacttggctatatttagccacaattattgcatttccatttattgaggctagccgtatcagaaaggccagtgaagtccttgaggtctcagccccctattaggcttcaagtaaagatcaggtgctctattgagttatttaa

SEQ ID NO: 1721 - DNA, 384 bp, Homo sapiens
tccaaaacacaaagcactgatttgtagttttctctgatttacatgttgtcagtactactgccttggctaatttcaagctaccaaggctttaacaactggtttgcaaaattctcaaggatttgacagttgattctcaggagccagtatgagctggttgcctcacactttgcttctaactcttgggggcaatgctttccctccactgttgtttctttccctttggaggggagtaagtgatgtaacacctgcttctttccacccctttattatttgctatcccaggggagctaatagtcatacccaagctcttccttttttcatcataggagttaggccaggtgcagtggctcatgtctgtaatcccagtgctacattgtaggtggt

SEQ ID NO: 1722 - DNA, 464 bp, Homo sapiens
gattttcaattggttcctcgagcatccccatgcgtgttggcagtatgtctctctgcaggccttcccttcctgaatgttccaggattaggcaatcctgcttccacacctttcccttgggtgcctgagaagaacgtactggctgctgctctgcttgctgccacagggggtcattgttgaatagggtctggtgcaatcttgtggccttttgtgccctgaagtttcattttgaggagttaccttcttacaaatggaggcagcaccatcccgtccatgtttagggctagacagtcttaatccagccgtgcccagctaccttgcagacgttcagtcataacagtcaatttgggtggctcctcctacaattttaaaatttattttatttattattattattttttgagacagaatcttgcttcattgcactccagcctgggcaacaacagcgaaactccatctcaaaaaaa

SEQ ID NO: 1723 - DNA, 635 bp, Homo sapiens
ccatgatcatgaggcttccttagccatgtggaactgcaagtctaattagacctctttcttttgtaaattgcccagtctcacgtacatcttttccagcagcgtgaaaatgaactaatacacctgccacaagggctgcccctgaaccccgaaccccaagtccactttcttgacaagtaagaatgcttcaacttttacctcaatgctgctgatgaggtcttgtactctgatgaaagcctgtggggaataataaaatcagctgccttcttggcttcaaaagtgggtgactgggtgggggtgggaagtcaagctcacctagacagtgagccacagaggagaggaagggagcaagcacaaattaatcatcgtgcgtgcaggaggttataccacccagtgaggcgcggctttatccccaaaattggatcatgcaaagaacagcaaagacatcccggttgcatcagtcattttgggatcaggtaaaacaaaaccgcgatgccacagtctgtggcggtgcctccttgggagactctcgagccaaagaagaagccagtttgaccctcggcggggggcggggggggcgggcaggcagcatcacagcaagagagagagagatgcatggactgatgagagactgccta

SEQ ID NO: 1724 - DNA, 474 bp, Homo sapiens
atcagttcaatccagtaaacaattctctctctccctcttactcccctcgcacacatgcacacacaccccacagatataatggattttagtttttaggcatcaaatgacttttgtgccttattaatattatccactgaatcaaaaacagcaagctgaaaaattcatctcaaggaagagaaaataagattgttgggaatggtgagaaaggaaacatggtttttgaaaattgattccagggaagataggctagtttgaatgccagtagggagccatcagaagaagtagttttacactgatttttaacaatattggagttgcttaaggcaatgcaatagagaggcagtttctgcccttttaaagcctgacttcactttctgaatgtgtgttctgatctagcagggttttttttttttttcttttaagatggtcccagcttgactgcattctcagatccatcagataaacgttagggct

SEQ ID NO: 1725 - DNA, 373 bp, Homo sapiens
caacatctcatatctcctaccaacagtctatccccttccagcatctcatttctccttccaacatctcaaggaagagaaaataagattgttgggaatggtgagaaaggaaacatggtttttgaaaattgattccagggaagataggctagtttgaatgccagtagggagccatcagaagaagtagttttacactgatttttaacaatattggagttgcttaaggcaatgcaatagagaggcagtttctgcccttttaaagcctgacttcactttctgaatgtgtgttctgatctagcagggttttttttttttttcttttaagatggtcccagcttgactgcattctcagatccatcagataaacgttagggct

SEQ ID NO: 1726 - DNA, 434 bp, Homo sapiens
ctcaccgtcctatggcagggcaggtaatgtccttaatgagatgggcttattccagtggagcagtggtggggaagcaaaagcttggtgttctctcctcatggttgcgaaaatattcacataaaagattcactagctactgttaataattgaaggactttcctcaaaatccatgtattataacggtttaatatactaaaatgatttggaggaaatcggcctcagcattggtgaatgtgttgacatatgaagctattatttttataattcttattttagagatggagtctcactgtctcacccagcctagagtgtgttggcaagatcatagctcactgtaacctggaactcctgggctcaagtggtccttctgcttcagcctcctgattagctgggactgtagtcacatgctaccacccatggctaattaaaaaaaa

SEQ ID NO: 1727 - DNA, 251 bp, Homo sapiens
ttcctgacttgatcctcttgcataatacggtgtgatttcctgtggtgaagcaggctgggaggggaggtccagggaccccacacaacattgaggtcccatctttgtcttgatgataaccccctaaccctcccaaggcatttgatttgaaatgtaatttgggatcactttcttggcctcctccagtgaaagagatttgaagatgatttctaaactgtggcattcttgttactaaaaaccctcctccaaggaag

SEQ ID NO: 1728 - DNA, 331 bp, Homo sapiens
ttttccggtcacttttggttaaatatgtagccaagtatttttttccacagtggcccatgatcctatttaatcaaatgttcaaacctcctaaatgatgccttttgtaccaacaactgtctttgagatttcccctaaggggccctagaaaatcaaaattccctttaccttgtaaaagagagatgttaaaaataatagtttatttgatcaaacgttatgggtcatatggaaagcactgtcaaagccagagaggcttaccctccctaagtttaagttaaatttgtataggtaaaatgttattaatagggatattttggaagttctatgaaggtat

SEQ ID NO: 1729 - DNA, 428 bp, Homo sapiens
gaaaatggaggtgatctcagatgtcaaaacacttccctgtgaatattactattttggacactggccattttaaaaatttcaatattcatttttttcctcaactgctatttcgtattcctgtggtatttattcaccaaacatgatgttaagattatgaaaacgatgaggagtcaaggtcttaattttgctctgacacggaatctattcctatttcatatacaggttggctgttattttctagcagatgctttcaggttgatgcatataaaattcacacactgtgtagaattaagtagagggggaaaggggaataggaaaaaaggatgaagggagaagtgagatgcttatttttttttgacaccaaaattgaatctttcagtgtaaggatttcaaagtactgacaaccattctcccatttgctgggtgag

SEQ ID NO: 1730 - DNA, 3746 bp, Homo sapiens
  misc_feature (1890)..(1890): n is a, c, g, or t
  misc_feature (3476)..(3476): n is a, c, g, or t
  misc_feature (3738)..(3738): n is a, c, g, or t
ggttggcagtggtcacgtcgcttgtcaaggcacccaggagtggggcccgagtggggatttcaggacgtgggctctcagggggagggaaagtggctaaccaggacttttgcaataccaaaatcagccacgcggtgtcatcctcctcccaagaggtctggctggggcttgcgggcagtttagggttggagccaggggagaagtcacagaagaattgctagaggtgaagttttgcattttgtttgcgtaacagccccacaccctgccctgcgaagatgcataaattagcccctggcccttccccacggttccttccttccctagtgtcttcccgtcactccagggactcccaatatggtgatacgaggcagcctgggggtgggggcagaaggaagtcctgccaacattcactgtgtgaccttgggcatttctctggctgcagtctccggtggccctcacattcgatggctctaggttccccagctgacctggcctgagggcttgggttgaggagaggatttgaccccatgtgaacagaaggctcccagggtgagtaagacatggccctggtttcacctagatctcagcctggccctgctggtgtgaaccggaggggagggtgagtggacagactggtttggcagctctggctgggctctggagggtggggagtttggtgggaagaaagccagggctacactgtagcaggaccagcaggtgtcaggactgggacatggaaggtgcaggggccaggcccagatagggagaagggaggaagactcctgactctataggtcatgtgtgcagcctcagcaaagggactgggatctccaggcctgggaggaggctggggctactgggttcactggtgggagatgcaggagtgaagccactgtctgtgctttggagtcaggagctcatgatggcatgaggttgatagttcccctcatccatccattcacccacccaaccagggccacccgatatggttgtatgggtttttccctggctgagggggcatgtgtggaccaaactccagctcatgtctgttcactgagcctgactcagtgggtttactctgctcccagccttcaagtcttggctacaacatggcaactctcttgatgagtggctctgggtgataggtggggtggggcgcatggaatgtcaaggccctggattcccagtctccatgggacttgcaacattgaagaaagttctgctggaggcagggggcagtgaggaagctcttttagatctggagacactggggcgtttggcctgtctccccttggttgcctggacctatagcttgggccgcccttccgttttcctccctcttgcatttcccatttgatgtaatatggccaaaagaggtgggaaagagaggaaaggaacctggggtctggtcctggttttggaagactcaaagatgaataaggcagataggaaactaagagggtggacatgcgggcgtcatagatgtacaggcaaaggggttcctccggacctgtgaactcctgtgaactcctgcatatgaaccctgtcctgggtctctggggggctgctgtgaggagcattgaggttctgtgtgcctgtaagatgggtcctcatgctagggatgaaggctctgtgtgaaagatgcagagacagatgagacaatggcaggagaacaggtgcaggggcgttgttagtggcccaggctctacttctggccctgcttctcacaacctctgtgatcttggataaatcaattaataactcaggcctcagtttcctcatctatgattaacagggctggaccaagaatacttgctgaggccctgacagtggggagggcctggaaaactccctggttggagtctgcagaggtaggatagcttcccccacgcnggctgctgctcacctcctccgcgctgcgtgcagccatctggcaatcatgaactgagctgtcctctgggtcagatgctgtgccaggtcctggtgctgagagccagccccttacctgggaagacagacacagtcagacaatcatggagcacggtaccaaagctgacacaggtacgtgcgtgcgtgcgtgtgtgtgtgtgtgtgtgtgtgtatgtggagggccgtttctgactcagtagagatgttcttgtcaggcttcagcagggaaggcatgtgcaggttgggtcttgagggatgtgtaggagttcctcagtccaaatagtcggcttcccacaggtctctagggaagtgctctatgggagtccatgtgcacaggaggccccagagggaggctatgtggactcagagctttgctcaagggctctacctcccaccaggccgaaacccacaggaagataccaggatggcagctcagcagcccgagggctgccatcagggcctgatctggggcccagacttggataaaacttcacttctcaatgcctctggtgagcctggaatgggggacagtcacctgcagtttccttagggcaggatgcacctggaaagacgatccgtcctttaacaggacaagcctgtgcagaagccggcacccactggatttggggaaaccttgtttctaggaactctttccccctgttacttcactggggaacctagcttctgccctgtgtctgagggcctccttggagccaccagaggtagcctggtagggtgggaagaccctgggtttctagccctagcttgctattaatacaacctggctgtgtgaccccaggtgagatgcttaacctctctgggtctggctttcccttttccctaaatgaggaggtgggattatttaatgagattagaggctctaaactgtgttctgaaggagctgtaaggtttttggaggagctttaggggccaaagagggtaagaaagagatgaatccaagggaatcttaaggggtcagggctctgggacccctgcccacctcagtcagaggagctgtggttttaggagttaaatccatcaggaggcaggatcctgtggtgatcccgtccttgacttagatgttctgattcaaatccccactctgacccttactagtaagaacttgggctgattgcttccccctctaagcctcagtttccttaattttaagatgggacaaaagccgggcacagtggctcccgtctgtaatcccagcacttcgggaggctgaggtgggcggatcatctgaggttgggaatttgagaccagcctgaccaacatggagaaaccccatctctactaaaaaagaataccaaattacccgggcatggtggtgcgtgcctgtaatcccagctacttgggaggctgaggcaggagaattgcttgaacctgggaggcggaggttgtggtgagccgagattgcgccattgcaccccagcctgggcaacaagagtgaaactccatctcaaaaaaaataaaataaaataaataaataaaaaataaatgggacaaacagcagtacctccctcatcaggtactgtgggattaantgagattatatatatatatatgctgggctccaaacagagcctgatatatagcaagcattcagtgaatcttaaccagcatcattgtgattccacacaggagcccatctgcttgaggaatttagctgtaaaaataaaagtttgaacactactggatgggatgatctagaacagggtgtccaatcttttggcttccctgtggcaccttgggaaaagaagaattgtcttgggtcacacataaagtacactaacactaaccatagcngatgagct

SEQ ID NO: 1731 - DNA, 201 bp, Homo sapiens
cagcatcaccacaaacatgtaatgtgttgtgcagcaatgttagtgtctgtgatgtagacatcactgggtaataggaaattttcatctccatgataatcttatgggaccaccatcatttatgcagtccatcgttgaccaaaatgtcattgtgtagtgcctgactataaaacctttttctacatttataatctcagcaaagtt

SEQ ID NO: 1732 - DNA, 520 bp, Homo sapiens
ctttcagagcccagccttcggaggtttccgcatgagccttctcgggcgacttctaggaggatttattcccctggcagtgccaagggcagcctgcaccaagctcacaactcttcctccaagaggatgttcaaagggcctgtcatttcagcatctgctggacagcagaacttcgcatgcaggatcctggagctgcgtcgggttttgaatcagggacaatggaggaagtgggaaactgtgaagagagtcagagggctgtgccagctgccccctttcccacccccagcaattcacttaactttcctgagtctcacctttgtcattatgagaatgtgtatatttataaataatcatctgtttctccaatgtaagatattgttattgcagaagtgatactaggacctcgttatacgatggcctcatgatgtagatttatagcaggcttcagattctggcatagaataaacagatatttatccaagggttcactgattcccgaataaatgccaggaacattcatgta

SEQ ID NO: 1733 - DNA, 1134 bp, Homo sapiens
aagggtgctgtgcagcaaggagcccaggagtggtatgaaccgtaacagtgcccttagagtaaatgtgcggcccctaagaccctgccctcaggaaggcggccttcccctgcagtcctgtgtcccacccctgggtctctgtagggtgccatccagggcaagcaacccaagcactgcttcccaccgggtgatgagccatgcaggcctccaaactgcacgtcatgattcatccctaaagtgagtttggccttgagagtccccagggtcctcccccactgggcaggggtcctcaaagccaaggaagcctggtgacacaggcacccatgggaggtgggcccagaaaggggcttcccatagataggccctgtgagtagggagcttgtacactgggccatgggcagcgccagttcccttgagcagtaaaggcccttttccccctacggtgggacccaggagtctctctgacagcttttctgccaggcacagtggctcatgcctgtaatcccaacactctgggaggccgaggcgggaagatcacttgaggtcaggagttcaagaccagcctggccaacatggtgaaacgtcgtctctgctaaaaatacaaaaattagctgggtgtggtgacaggcgcctataaccccagctatttgggaggctgaggcagtagaatcgcttgaacccagatagcagaggttgcagtgagctgagagtgtgccattgcagagagactccatcccaaaaaaagacagctgtcccaggccaagggtacttgggagagcccctcatggagaacctagtttagaccaagtagcagaagctgtggtcataacaaaacaatttgaggaagaaatcttacaaatcaccactgccctttctccttttccataaaactgtccatcttttcggtgctccctaatccaagcagcttgactttagagaagttgcagaagcagtgaagccactaacatgctgtgtgactttatgcaagtcactcacctcactgagccacctccatttcttcatctgtgaaatgggcataacagtaatacataaccctacctacctcacagggctgttgtgaggatcaaatgaaataatgtaacgtgagaatacagtataaatgataaaggattgtta

SEQ ID NO: 1734 - DNA, 227 bp, Homo sapiens
gcggccgcctactactactactgctcgaattcaagcttctaacgatgtacggggacatgctgtgtgactttatgcaagtcactcacctcactgagccacctccatttcttcatctgtgaaatgggcataacagtaatacataaccctacctacctcacagggctgttgtgaggatcaaatgaaataatgtaacgtgagaatacagtataaatgataaaggattgtta

SEQ ID NO: 1735 - DNA, 933 bp, Homo sapiens
agcggggcttttcgaggcagttagtgggtcccaacggctgcaggcggggccggcgggggcgcagcggcccgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagattttgctcattaacagaaacaaagaggagaatgctacgcggatcctccagcggttgtggggcacccaggatgtttcccaagacatccaggagatgaacgatgagagtgcaaggatgtcacaagaaaagcaagtcaccgtgctggagctctttagagtgtccagctacc

SEQ ID NO: 1736 - DNA, 754 bp, Homo sapiens
agcggggggggggccggacaaccccgaccgcgagccggacccctgctctgacgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagattttgctcattaacagaaacaaagaggagaatgctacgcggatcctccagcggttgtggggcacccaggatgtttcccaagacatccaggagatgaacgatgagagtgcaaggatgtcacaagaaaagcaagtcaccgtgctggagctctttagagtgtccagctacc

SEQ ID NO: 1737 - DNA, 735 bp, Homo sapiens
agcgggccggcggggtgcgcagcggcccgggagggggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagtcctccagcggttgtggggcacccaggatgtttcccaagacatccaggagatgaacgatgagagtgcaaggatgtcacaagaaaagcaagtcaccgtgctggagctctttagagtgtccagctacc

SEQ ID NO: 1738 - DNA, 723 bp, Homo sapiens
caccttactacatgaattatatggttgtggttgttttagggatgattgtactggacctactttctgttacactctttccctgcctctcagaatccaagtgaggagggttctgattactcctgagtaaaattttcagcccctaaagaatgaggtgaaaaggcgggtttaggaatggatgctatcaggcagggtgtgtggctcacgcctgtaatcccagcactttgagagaccgaggtgggtggatcacttgtggtctggagtttgagaccagcccgaccaacatggagaaaccccgtctctactaaaaataaaaaattagctgggcatggtggtgcatgcctctaatcctagctactcgggaggctgaggcaggagaatcgcttgaacccaggaggcagaggttgcagtgagctgagattgcgccattgcacttcagcctgggccacaagagtgaaactctgtctcaggaaaaaaaaaaaaagaatggatgctacccatcacctcacctcgtgcggccctttcctggctgccttacaggaagaatgaatttggggcagcacattctctttatcctttcctctttcttcttttcaccagtcctccagcggttgtggggcacccaggatgtttcccaagacatccaggagatgaacgatgagagtgcaaggatgtcacaagaaaagcaagtcaccgtgctggagctctttagagtgtccagctacc

SEQ ID NO: 1739 - DNA, 944 bp, Homo sapiens
agcgggccggcggggtgcgcagcggcccgggaggtgcgtggttgagcgaagccgcggggcccaaccgcagtcgcggggtctgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagattttgctcattaacagaaacaaagaggagaatgctacgcggatcctccagcggttgtggggcacccaggatgtttcccaagacatccaggagatgaacgatgagagtgcaaggatgtcacaagaaaagcaagtcaccgtgctggagctctttagagtgtccagctacc

SEQ ID NO: 1740 - DNA, 1022 bp, Homo sapiens
agcggggcttttcgaggcagttagtgggtcccaacggctgcaggcggggccggcgggggcgcagcggcccgggaggaagcagtaccttgaagagaaattggagagggagtcaattcctaggatagcagagagatggacaacagacagaatagatggagtttcacaatggtggccatgtgtctggaattggtgggttcttggtctcactgacttcaagaatgaagccgcacaccctcgcagtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagattttgctcattaacagaaacaaagaggagaatgctacgcggatcctccagcggttgtggggcacccaggatgtttcccaagacatccaggagatgaacgatgagagtgcaaggatgtcacaagaaaagcaagtcaccgtgctggagctctttagagtgtccagctacc

SEQ ID NO: 1741 - DNA, 1166 bp, Homo sapiens
  misc_feature (147)..(147): n is a, c, g, or t
  misc_feature (215)..(215): n is a, c, g, or t
  misc_feature (231)..(231): n is a, c, g, or t
  misc_feature (245)..(245): n is a, c, g, or t
agcgggccggcggggtgcgcagcggcccgggaggtgcgtggttgagcgaagccgcggggcccaaccgcagtcgcggggtctgggaggtattcatccatggggttcttccgcggtgaagccagcttgtcgtgctgtcccccttgtcantgaagccatcatggttctggtcaatcatgttgaaagcctccttaaactcctggatgtggaactggtcnaacatcacgaagacantggatgtggccccntgtgctgtggtcgcttcttggtcttggctttggtccacttgctgaacattttggcttcgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagattttgctcattaacagaaacaaagaggagaatgctacgcggatcctccagcggttgtggggcacccaggatgtttcccaagacatccaggagatgaacgatgagagtgcaaggatgtcacaagaaaagcaagtcaccgtgctggagctctttagagtgtccagctacc

SEQ ID NO: 1742 - DNA, 1033 bp, Homo sapiens
agcgggccggcggggtgcgcagcggcccgggaggtgcgtggttgagcgaagccgcggggcccaaccgcagtcgcggggtctgggaggaagcagtaccttgaagagaaattggagagggagtcaattcctaggatagcagagagatggacaacagacagaatagatggagtttcacaatggtggccatgtgtctggaattggtgggttcttggtctcactgacttcaagaatgaagccgcacaccctcgcagtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggcgcaattcaatgctgattgtcaacctgttggctgccactggtggctgccttatgggactgtgtaaaatagctgagtcagttgaaatgctgatcctgggccgcttggttattggcctcttctgcggactctgcacaggttttgtgcccatgtacattggagagatctcgcctactgccctgaggggtgcctttggcactctcaaccagctgggcatagttattggaattctggtggcccagatctttggtctggaactcatccttgggtctgaagagctatggccggtgctattaggctttaccatccttccagctatcctgcaaagtgcagcccttccatgttgccctgaaagtcccagattttgctcattaacagaaacaaagaggagaatgctacgcggatcctccagcggttgtggggcacccaggatgtttcccaagacatccaggagatgaacgatgagagtgcaaggatgtcacaagaaaagcaagtcaccgtgctggagctctttagagtgtccagctacc

SEQ ID NO: 1743 - DNA, 744 bp, Homo sapiens
agcggggcttttcgaggcagttagtgggtcccaacggctgcaggcggggccggcgggggcgcagcggcccgggaggaagcagtaccttgaagagaaattggagagggagtcaattcctaggatagcagagagatggacaacagacagaatgtcaccccagctctgatctttgccatcacagttgctacaatcggctctttccagtttggctacaacactggggtcatcaatgctcctgagacgatcataaaggaatttatcaataaaactttgacggacaaggcaaatgcccctccctctgaggtgctgctcacgaatctctggtccttgtctgtggccatattttccgtcgggggtatgatcggctccttttccgtcggactctttgttaaccgctttggcaggtattgactagaaactgggcaaggaagtgggctctaccagatgcattggggacaagtgtggagagttagggcagggaggtgatgatgcctttgaataagaacaccttgaattctaatcaagggaaactagcccaactggccccgaatatgactgcccttgcttggagctctactaccctggatagctcccacccagctgtgcaagagatgaactgtgtgagtgattggcctttgcagtccagttagggatagttcagaattattccctagtaagctcaactatggggtttccaggaacatacttaatttacaaggtccaaagttgattacttttctcaaa

SEQ ID NO: 1744 - DNA, 383 bp, Homo sapiens
ggtttttaaatatttccaaactgaccaacccagtttctcttaacttcttccttctccaattttcttttccacttttaccaagttaacttcacattcttatctccagataagttctttagtataatctattactttgtcttcccgattaattacctaaatctcgtttgatgtttgtccttttcataccactcataggtcagattctcctaatacagctccataattaataagaaacagtcatcaattacaagttttaaggactattctctcctccctgtcctctgtctctccaggtcaccccagctctgatctttgccatcacagttgctacaatcggctctttccagtttggctacaacactggggtcatcaatgctcctgag

SEQ ID NO: 1745 - DNA, 460 bp, Homo sapiens
aaggcaaatgcccctccctctgaggtgctgctcacgaatctctggtccttgtctgtggccatattttccgtcgggggtatgatcggctccttttccgtcggactctttgttaaccgctttggcaggtattgactagaaactgggcaaggaagtgggctctaccagatgcattggggacaagtgtggagagttagggcagggaggtgatgatgcctttgaataagaacaccttgaattctaatcaagggaaactagcccaactggccccgaatatgactgcccttgcttggagctctactaccctggatagctcccacccagctgtgcaagagatgaactgtgtgagtgattggcctttgcagtccagttagggatagttcagaattattccctagtaagctcaactatggggtttccaggaacatacttaatttacaaggtccaaagttgattacttttc

SEQ ID NO: 1746 - DNA, 327 bp, Homo sapiens
caaagacataagatttggggtaaacatctgggttatagctgcatgaatagcaactatagaaaaacacacacacaaatgtgtatgctaacaaaggagagacctgatatggcaatcttaatgtcagaaaaagtgtaattagaacccaaaagagcagatcgagctgtgaacagtggttagttagatcaccacaggtcctttcaaaggatggagatagccagtaacttactctgaatgaacatgacaaagatatcttcccaggtaaactctcctcaaaacatgccaaggtattgctctcccccacccttccaaattcatatctcctccttc

SEQ ID NO: 1747 - DNA, 178 bp, Homo sapiens
ttcatgctgaagaggaagatgtaaaggtgcacttgtgtagaaaaggtgaggaagcaagtgtcctatagagatacccaaacaccagcatttgttttattataaaccatcatatagattaaaataatctttaattgtggtcttgtgctattttaattatgtaataagtaatgtcttaagt

SEQ ID NO: 1748 - DNA, 563 bp, Homo sapiens
tgctaggattacaggcatgagctacagtgctcagcctttcatgttctttttggactttactacctttgttttctcggcctagaatgttctttgtcttatttgcctgatttttcttctcttacttttcctacttagcatcaccttttacatggttgagttagatttctctttcctgtatttctgttagagcctttcttatatgagtcattcatttaaaaatggacaattaactttctaagcttcaatagcctcgtctggaaaatggagttaataactcagtcaaagctcccttatctgatttccacttacctgagtcttcagatggatcctcccagttccctgtgaaaagcttgatgaccagcatccacatcacgctgaatgctctcaaccatgcttgtgcacaactcttgccagtcaattgtgtaacataatttatcttacttgttattgtaattaaatgcatggactaaatatgttaaattatgaaatatgaatacaaaagaaggattacttctgtgaaaattaaactgaatgacttggaataacaataaaaaaagttgcta

SEQ ID NO: 1749 - DNA, 419 bp, Homo sapiens
gataattcatggagagatgtgatgcccatttgagaatctggattcttttgagtttggtgatatgaaagtctcttttgtgaccttgagaaagtgggaggttttgttatttgttctgttgtcctttaaaatttaaaactggctgggcgtggtggctcgtgactgtaatcccagcactttgggaggctgaggtgtgaggatcacttgaggcctgaggtttgagacaccctggaaacatagggagaacctgtctctagaaaaaaaatttaaaaattagctggatgtaatggcatgtgcctctagtctcagctacttgggaggctgaggcaggaggattgcttaaacccaggagtttgaagttacagtgagccataactgtgctgttgcacttcagcctgggtgacagaaagaggccctgtctc

SEQ ID NO: 1750 - DNA, 331 bp, Homo sapiens
attttacttttatcaaattaccatcttggagggctactgagagcaacatttcgagggcttatcatgtaacaggccctgggctatcttcacatataagtcctcacaacaatcctatgaggtaggattcatcagccccattatacagataaggaaatcagtcttagaacaatcagttacttgctcaaatgtacaaagctagaggtagcagagctggggactgagtctaggtttatctgatttctgagtgtgtaatgggtttacaccaagagtgctgtgggaaaatcttgcatgtaactgcaagtatgcgtttgacttttggcacccttatctc

SEQ ID NO: 1751 - DNA, 497 bp, Homo sapiens
cagtgttttcagtctcctttgggaagaaacccattctctgtcttggtaagtaatgaaataatagtacttttaacctctttttggagagaacatagactttgggtcagacagacttggattctaattctggaaattcggtaactagctaagtgacctgagacaagtgcttaatttctttaagcttcagttgtaatcagaaaatggagatcctggctgggctcggaggctcacacctgtagtcccagcactttgggaagccgaggtgagagaatcacttgagcccaggagttcgagaccatcctgggcaacatggcaaaactctgtgtctacagaaaatacaaaaattagctgagcatggtggtacacgcctgtagtcccagctaatcggatgctgaggtgggaggattgcttgagcctggaaggttgaggctgcagtgagccatgatcgagcagctgtactccatcctgggtgacagagcaagattatgtctcaaaaa

SEQ ID NO: 1752 - DNA, 587 bp, Homo sapiens
actctcttagactccagtacacttgtcatgtggtgggggatctgaatagtcaattcttgattctgtaatcttctcagcttcctggataagcatacaaatggcagccactgccccatgcaaggggagacaacctcttgccacactatcacattatttagtaagttgtgcagcacccttttcatgggtcctagcatctgggtcagcattccaagagctattctctgtcgttcatggatgtagatgtcaaaaggctcagttatgttggggagctgtagggccagagtctccagtaacagcttttgaagcttctggaaagcctgatcaaatttcccatcccattcaaaaaggtgggtgtggccaggcgcagtggctcacgtctgtaatcccagcactttgggaggccgaggtgggcaggttgcctgagaccaggagtttgagaccagcttgggcaatgcagtgtaaccgtctctactaaaattacaaaaattaaccaggcatggtggcacatgcctgcaatcccagttacttggaggctgaggcaggagaatctcttgaacccaggagatagaggttgcagtgagattatg

SEQ ID NO: 1753 - DNA, 913 bp, Homo sapiens
gtgacgtatcaggaaacatattttattggagatttggaagctatagtaaaacataatggcaataagccaacttcccagtggtaaacccacagtggtggtttagttactaacctcttgatgaccgaggaggttaataattggatattgcagagcagcaatatgtaacctgtgtgtaatctcagggcctcaggttaacagtttcagtcagaagctaagagaaacactgacaaaatttagcttaccatgactagctgccagtttatgtggtctgtgttcgtttgttttaaagaaactaatactgtacagagatctttgacaccaacttcaaggcaccagtgtttagtgcaagcaggtagagaggacctatgaactaggtttctaattggcagtcagtgctaattcagccattagtaagtaaagtcacttttccactaaaatagtgtcccgactaaccacctccttccgtgtcttttccaaccacaaaaccacacacatagaccatctcatcttactttatttcttgcatttattgtatccaaaaaaattggtttagttttttaatgtaattgacaagactcaagcttttgaaatacttacgactgttctcttgattccaggacaccctcccctgtgtctaaacatgtgtggtatactttttaaataaattaaagcttattttacttggcattttgtggagggaattttacaacacctcgggagatatctgcagacaccctggggtgtcacaaatttaagactagaagtcattgccctaatcaaagacgactgttacactggtctagacatcttaggggaactccaaaatgtttatacttcaactctcagtaaaagctcaagcttgtcttttgccttaccaaattccatatctcaaaataaacttttctccctctgg

SEQ ID NO: 1754 - DNA, 172 bp, Homo sapiens
atgtctctaaagaagaaaccagaggctacattaagcttgtcagaacaggctgattttgaggtaaaattggagcagacattaggggtcatagcctagaataaggtgatggtcaaggtgggaccagcaactctctgggtgttcaaacacctcaaccatcccctaaatgttagct

SEQ ID NO: 1755 - DNA, 300 bp, Homo sapiens
gttatgtttaaggaatgagaagacactcaaagtaggtagccttttgaatgaaaatgaatgaataaactaattccttaataagggaaattataaatgttctttgatttgcaagtaacttctagaaaattgtccaaccctttgttcacagtataattaaaaataagaaattataaatattctttgatttgcaagtaacttctagaaaattgtccaaccctttgttcacagtataattaaaaataagaaagtattaggttctttttctgactttcctccaaactgaaagttaaatgtctctaa

SEQ ID NO: 1756 - DNA, 459 bp, Homo sapiens
agctcatttatccaacaaacagggtacagtaattgagagcctgggctctagagccacacagaccctggtttgaagccagttctgccacttcctagctatgtaatcttactaagtgctgtattactatcaaaaggaaagaatttaagtgattcaaataggggttaaaagcattattcatctgggcgcagtagctcttgcctgtaatcccagcactttgggaggccaaggtgggcggatcacctgaggtctggagttcaaaactagcctggccaaaatggtgaaaccctgtttctactgaaaatacaaaaattagccaggtgtagtggcatgcacctgtagtcccaggtacttgggaggctgaggcaggagaactgcttgaacccaggagatggaggttgcagtgagccgagattgtgccactgcactccagcctggatgacagagcgagacttcatctca

SEQ ID NO: 1757 - DNA, 493 bp, Homo sapiens
cctactagaaagcagtttcatctacattggaaatctgttgtttaatgtagccactttcatcaatgatcttagctagatcttctggataatttgccacaaacttcagtttgtttaaaaaacaaaaacaaaatgcaaatctgcaatgcacaatacagcaaagtgcaatgaaacaaggtatgcctgtaatcaaaaaaacaaagcaaactaaaataataaggactataacttcattcaactcttccagatattttgaacttggatttgaagtggattggctttctaagaaagtattatttattaaaactgatcctagaagagatagagtatccccaaaaaaacccattcccatagaaggggaaaaaagtttttcaaaaatctcccacaccttacattaacacttaaagcaatgggccctgatagtttcacgatagaattttaccaaacctttaaggggccggtaattctaattttatttaaactgttcttgagagtt

SEQ ID NO: 1758 - DNA, 243 bp, Homo sapiens
gatactcacagatctgaagcagcagtgtccagtagaactttctatagtgatggaattgttttatgtctgcattgtctaatgctgtagccattagctacatgtggctagcaagtacttgaagtatagctattgtaactgaggaactaaattttaaattttatttaaatagccatatggtgttttttgtattggacagattcagagcctcattctctagatgcttctatgcttcttgagcttcat

SEQ ID NO: 1759 - DNA, 284 bp, Homo sapiens
cagatattttatatagaacagtgttttaaggacagagaaagatgataggttttcaaggattccgttgtcactggatataggcatttgccttttgtatgtatttaagaatttgcattcttattctgttctgagcagaagatctttttctagcgcaatgatagcatgtggtgtgttgtggtcccgaaatgtgtgcagtgaggtcattatcaaccccagactagtttctgtctttaatgcacattaattcacatgtcatcagacatgaaaactaaagtgtttagaac

SEQ ID NO: 1760 - DNA, 402 bp, Homo sapiens
catttttttcaactataactaagttacttttgttttaaaccaaaagtaacttagttatagttgaaaaaaaagagtttccctcacagaaaaagcatgtttatctgtaaaactgttagctgagcaaaataactagtgttgccagataaaagcaagctaccgataggggtatataaaataggacatcagaaatgccattgcaatattttatcaattctgtgatgcatgtaattttacattaagttatgtaaaattaagtgatgctatagttaaattgacagcattttttttcctagtggtaaatgaggtatgtcttgtaatgaatagtatcttagattttatgaaacacaatattactgaatttagactggaaacgtgttttaatctcctaaagttattacaaaa

SEQ ID NO: 1761 - DNA, 587 bp, Homo sapiens
atgcctcccagagaaagtaggctagagagggcaggaatagcttgacttagagatcacttccactggcacggtgggtacaatctgatgtgggaggctctgggtgcagcctgtgatggcagagtggaggagccaggagtcattcttggcctcattgtcactgccttcaaactaacaagttgcctgagagctaaggttccatttgataggacaccgggtgggatgtgcatcagaatatccatttccttgaaggatccaatgattaggctgaggcaaaatgttttagaccattcccaggtctaaaaataactccatcatcacctctaataaggactcagtctggagtgacatcactccttcaggtgcagaaaaggaaagcatgactgtgtgtcactgacttaaaataggagtgaggtgagaggggcagctgggctcatggacgtcaagtggacagtttctcagctggtatttcctatatttcctgttttggacagcaggttcctgcccttctaagctgggggtaggggtgagggagtgtatgttaaaaagctctgtggacttgctttttctcttctccatgtgtgttcttt

SEQ ID NO: 1762 - DNA, 471 bp, Homo sapiens
gcaagtgatactcagttttggatctgtggattttgagttacagtgggatattctcttggttgtattgtatgatgcatcttgggaaattgatgtcagtttaggagtgacattagggctagagattgagatttgggattctccatagaaggagcagctaaagctcaggtccatgggtaagatgttaagaaaaactgtggaatggagaaggacaagaaaactagggacagaatttggagaataagtcgatacttttttcttttaagccagaatctaaataaggaattttaggttagtttcacccacgtcccccaccccttattccccaccccccaccccaccattctatttcaaggagagaaaaggataaataagaaggacataaacatttgttagtagttgattatcgaaatcccaagggactgaaagactgcctagggtcttatagcaatgcaaaatcaacaacaacaacaa

SEQ ID NO: 1763 - DNA, 592 bp, Homo sapiens
gccaggccctggctgccagccgaccgctctcggagcctcatgcgttcctttctctttgaaggtgccactcctgggctgatcctactatgtgccagctgctagagaaaccaagtgcatttgtgatttccaacctcgcttaggccccagattctgggcaacaaccctttgctgggatctcagccgcttgtcacagccactcctcacagggcacctgcctgaggcctcagcctccaccattcctcccccctgctgaccccttcttctcagggcaccccgggaaactagaccctcccttatagggaggtctcttgggaaagggagaacattcatttgaacacacatcaagagcttgggaaaaactcaaacttgctagactgaaaaacagtggagtcaaactgctcctggtctagcaactttccacattggagataaccctgagaccatggcactggacccaagagaaggaaatgcaaacctccttccttctgaagccaatgttggctgctgcgtgctggctggaagcctggggatgcttggagacagtaagtacacagtaaggatctcatcaaccttggtgatggaaaagtaatca

SEQ ID NO: 1764 - DNA, 377 bp, Homo sapiens
aatcaaggtgaaaacgactggagagagtagcaagatggtccagtctgggaggggtcaaagaaagggcagagccgggtgtggtggttcactcctgtaatcccagtactttgggaggccaaggcaggtgggtcccctgaggtcaggagttccagaccagcctgaccaatatggtgaaacctggtctctactaaaattacaaaaattagcggggtgtggtggtgtgtgtctatagtcccagctactctggaggctaaggcaggagaatcgcttggaccctagaggcagaggttgcagtgagctgagatcacgccactgcacttcagcctgggcgacagagtgagactccgtctcagaataaataaataaatgaataataa

SEQ ID NO: 1765 - DNA, 400 bp, Homo sapiens
atttcaaaggagcccaattaattgataaggtattagcaccaacaatgtatgaagttcccaggatttttctcaaagagaaaacataaagccttgagttcgtgtccggcataccccgtatatctaattataatgaaagatttaaagccttgcacctggtaccgttgctcttcttgtaaccgtttgtcttttaaattgtttatcactttgtaaccatttgttttttgattttggcatgtttttacttctgtagaattattgcatttgagttcccctccccttcctaaacctagatataaaagttaatcaactcccttcctcggggccgaaagaattttgagctttagccgtctctttggccgccggcttaataaaggactcttaattcgtgtcaaagtatggc

SEQ ID NO: 1766 - DNA, 508 bp, Homo sapiens
catattggctaaatggataaaaaaaataaaaataggatccagtgatatgctgcatagaagcactttagatctaacaccacataaaggctgaacttgaaggatgaaaaaagatatgctatgcagacaataaccaaaagacagcagggatatctatactaatatgaggcagaatagactttaagtcaaaaactgtcacaagagactaagaaggatactatataatgattaaagggtcaattcaccaggatgatatagtaattataaatatttatgcactaaatatcagagctcttaaatatgtgaagcaaacattgacagaattgaagggataaatacatatcaacacagtaatagtaggagatttcaatagcccactttcaataatggataggaccaccagatataagataagatcaataaagaaataaaggacttctcttttttttcccccaaggcggcagatcagagactcttttagcatgcttcacctatttggaagcaaaaaaaa

SEQ ID NO: 1767 - DNA, 1449 bp, Homo sapiens
agaactcaccctcctgagtaaaccccatccccctagctagacttcatcctcctggacagatcccatccccccagctagacctcaccctcttgggtagatgcatctccccaaccagaactctcctgggtagaccccttctacccagctagacctgatcctctggacagaccccatcatcccagctagacttctccctcctggactgtccccatcccccctcacagccagacctcacccctctgggtagaccccatccccccaactagacctcaccctcctggatggactctaccctcctggagataccttcccctcctgggtacatcccacgtggctacacactccttcccctgtcagctttctcccccagggttctgggcagcagagtctgtgataaaggatactaagtgattccccaatacttcccgtttccagcctccagtgggctctccctggggctaacggttctttttgctatttctccaggctttgcctgatgacaagtatactctgagagtgtcctaatgatacagattttggaccctatcccagttctactgaatccaagtctctgggggaggagttggggctctgcatctggacaccttcctgcagggtccccatcctagaccttcagcagctagcagaggatgtccccaccatccctcagcccacactcccactgtcgccccagccaggcttggcactgcctcctttctcagaagattaagaccatctgctgtttcccaagtttcccaccctccaccctaaaaatttctccgtttcccagtctttcctcgtctctcagaaaataaacatcttcccaggctgcctccccagtgggtctgcactccttgctgtcttcccagcacctgcccttccagcccgccctctgtgtgtccagtgtttccctcaccaaaggactcgctttgtttttcaaattggaggttttgtctttctccctaaaaaccaaaacatctccctgagaagtaactccctcaagctactgatacggaaggggggcggggaagtgctgggaagggaagggtgtggtccctggctagggctccacccccgggcctgtgcccacagacctaggtgaggacaggcatttctgttttcgtgcttaaatgttggatttcccaagactaccctggcctaccacaccctcattctgtgcctgtaaaaaaacctgagagcttagcaggcacgcacacaagcctctggacgtcaagaggaacacaccggtgtaagagcagactgatagtggcccacggcaggctggcaggccatcgacaggcagaaccactcagtgcagctggaggacagcctggccacggagcggtccgacttcagaggggaaaaccacctccccactccgtctcccttctggctcccccatctgagagctacttccactcaataaaaccttgcactcattctccaagc

SEQ ID NO: 1768 - DNA, 542 bp, Homo sapiens
atcctctggacagaccccatcatcccagctagacttctccctcctggactgtccccatcccccctcacagccagacctcacccctctgggtagaccccatccccccaactagacctcaccctcctggatggactctaccctcctggagataccttcccctcctgggtacatcccacgtggctacacactccttcccctgtcagctttctcccccagggttctgggcagcagagtctgtgataaaggatactaagtgattccccaatacttcccgtttccagcctccagtgggctctccctggggctaacggttctttttgctatttctccaggctttgcctgatgacaagtatactctgagagtgtcctaatgatacagattttggaccctatcccagttctactgaatccaagtctctgggggaggagttggggctctgcatctggacaccttcctgcagggtccctcctgggaggcaagcccggggagcaccgctgaggctcgcctcagtgcccatcctagaccttcagcagctagcaga

SEQ ID NO: 1769 - DNA, 417 bp, Homo sapiens
agcaccatatttataattatacatgagtgccaaacaatctcagttttaacgtttgtggtttttactgttcagactattcagaagttccatgacgtggcatccattgatgatggttttgctgaggttgaaatgtgagggttttgtggcaggtgtgtggaagcagatcccttagctaagagagcgcctgctcaacctgccaggcgtgtgctgggaacttccaggagttgcctcgtttaattctcacagccatcctgggaggtaggcgctgtctgccccaggtgggaggccaggaactgtggctgagagaggttaagtaccgagctcaagtcattcatagagtcgccagtggagccgcaattttaaggctgactcaaagcctctgagccagttacctcggctgtcaaatggagataataa

SEQ ID NO: 1770 - DNA, 557 bp, Homo sapiens
aatgtttaatattatgagacaatcaggaaaatctgaacactgaatagttgataatataaaaaactcggggggctaggtctgatatatttggtttgtagttttataaatggaggttttgttagatatacatactaaaatacttagtgatatttatcttctaaagatgtatactaaaatattaactgatgaaataatatgatgtccagaaactgcatcaaaataatccagggagaaagaactaataatctggtgtggcaatagaccgaataatattaaccatagttgaaaattgttgaagttggatgatgggtccatacagttctctcaacttaattctaggttaaatacaatgattgtaacaatatgcgagagccaagaagaggtgtatgaaaccttctctacatcatggtctatgaaccacaggagttcagtagggcagccatcctgttgtccacctttttcccaagcaggagcacccagttccaagggagctctcctggctgaagcaaagaatgcacaccagcctgggcaacatggagaaagctgtctctgtaaaa

SEQ ID NO: 1771 - DNA, 2070 bp, Homo sapiens
ggctggtaccgtccgggagtttgggatccagtgcctggctatggcccgactgctcaggtctgcaacctgggagctgttcccctggaggggctactgctcccagaaggcaaagggagagctctgcagggacttcgtagaggctctgaaggccgtggtgggcggctcccacgtgtccactgccgcggtggtccgagagcagcacgggcgcgatgagtcggtgcacaggtgcgaacctcctgatgctgtggtgtggccccagaacgtggagcaggtcagccggctggcagccctgtgctatcgccaaggtgtgcccatcatcccattcggcaccggcaccgggcttgagggtggcgtctgtgctgtgcagggcggcgtctgcgttaacctgacgcatatggaccgaatcctggagctgaaccaggaggacttctctgtggtggtggagccaggtgtcacccgcaaagccctcaacgcccacctgcgggacagcggcctctggtttcccgtggacccaggcgcggacgcctctctctgtggcatggcggccaccggggcgtcggggaccaacgcggtccgctacggcaccatgcgggacaacgtgctcaacctggaggtggtgctgcccgacgggcggctgctgcacacggcgggccgaggccggcatttccgcttcggcttctggccagaaatccctcatcacacagcctggtactcaccttgtgtgtccctgggacgtaggaagagtgcagccggctacaacctcacggggctcttcgtgggctccgaggggacgctgggcctcatcacagcaccaccctgcgcctgcaccctgcccctgaggccacagtggccgccacgtgtgcgttccccagtgtccaggctgctgtggacagcactgtacacatcctccaggctgcagtgcccgtagcccgcattgagttcctggatgaagtcatgatggatgcctgcaacaggtacagcaagctgaattgcttagtggcgcccacactcttcctggagttccatggctcccagcaggcactggaggagcagctgcagcgcacagaggagatagtccagcagaacggagcctctgacttctcctgggccaaggaggccgaggagcgcagccggctttggacagcacggcacaatgcctggtacgcagccctggccacgcggccaggctgcaagggctactccacggatgtgtgtgtgcccatctcccggctgccggagatcgtggtgcagaccaaggaggatctgaatgcctcaggactcacaggaagcattgtcgggcatgtgggtgacggcaacttccactgcatcctgctggtcaaccctgatgacgccgaggaactgggcagggtcaaggcttttgcagaacagctgggcaggcgggcactggctctccacggaacgtgcacgggggagcatggcatcggaatgggcaagcggcagctgctgcaggaggaggtgggcgccgtgggcgtggagaccatgcggcagctcaaggccgtgctagacccccaaggcctcatgaatccaggcaaagtgctgtgaagggggtctgagcacttagcccacaagttccctgactacggagccggttctggaacttttcttcatgccacggcccctgcaaggaaatagatgctgaggcagtcttcctgccagcgagcccactgtatctgggcccaaggccagagggcccagagagaagcctgagcaccgtgttacctccctggccctctggctggccccaggagcctttggttcagtaaacgacccagggtggttcccagcaaagctgcttcctctctgctcctacgcatcctgtcctggcgggaagagagcgtctgggtccattcaagactctgatgacacccctccccgaggcctcccactgccggggtcccaggacccttcccccttcacctggtgacaggaacactcctttcctggtatggaacgtgagctcccgtgacatgatgataggtcttctccttggggcctcccccaataaatctgtaataaacctgaaacccacctacagctacctggaagtca

SEQ ID NO: 1772 - DNA, 2007 bp, Homo sapiens
gtcaccctgccacccagtgctcacaccctctggccagtgcctggctatggcccgactgctcaggtctgcaacctgggagctgttcccctggaggggctactgctcccagaaggcaaagggagagctctgcagggacttcgtagaggctctgaaggccgtggtgggcggctcccacgtgtccactgccgcggtggtccgagagcagcacgggcgcgatgagtcggtgcacaggtgcgaacctcctgatgctgtggtgtggccccagaacgtggagcaggtcagccggctggcagccctgtgctatcgccaaggtgtgcccatcatcccattcggcaccggcaccgggcttgagggtggcgtctgtgctgtgcagggcggcgtctgcgttaacctgacgcatatggaccgaatcctggagctgaaccaggaggacttctctgtggtggtggagccaggtgtcacccgcaaagccctcaacgcccacctgcgggacagcggcctctggtttcccgtggacccaggcgcggacgcctctctctgtggcatggcggccaccggggcgtcggggaccaacgcggtccgctacggcaccatgcgggacaacgtgctcaacctggaggtggtgctgcccgacgggcggctgctgcacacggcgggccgaggccggcatttccggaagagtgcagccggctacaacctcacggggctcttcgtgggctccgaggggacgctgggcctcatcacagcaccaccctgcgcctgcaccctgcccctgaggccacagtggccgccacgtgtgcgttccccagtgtccaggctgctgtggacagcactgtacacatcctccaggctgcagtgcccgtagcccgcattgagttcctggatgaagtcatgatggatgcctgcaacaggtacagcaagctgaattgcttagtggcgcccacactcttcctggagttccatggctcccagcaggcactggaggagcagctgcagcgcacagaggagatagtccagcagaacggagcctctgacttctcctgggccaaggaggccgaggagcgcagccggctttggacagcacggcacaatgcctggtacgcagccctggccacgcggccaggctgcaagggctactccacggatgtgtgtgtgcccatctcccggctgccggagatcgtggtgcagaccaaggaggatctgaatgcctcaggactcacaggaagcattgtcgggcatgtgggtgacggcaacttccactgcatcctgctggtcaaccctgatgacgccgaggaactgggcagggtcaaggcttttgcagaacagctgggcaggcgggcactggctctccacggaacgtgcacgggggagcatggcatcggaatgggcaagcggcagctgctgcaggaggaggtgggcgccgtgggcgtggagaccatgcggcagctcaaggccgtgctagacccccaaggcctcatgaatccaggcaaagtgctgtgaagggggtctgagcacttagcccacaagttccctgactacggagccggttctggaacttttcttcatgccacggcccctgcaaggaaatagatgctgaggcagtcttcctgccagcgagcccactgtatctgggcccaaggccagagggcccagagagaagcctgagcaccgtgttacctccctggccctctggctggccccaggagcctttggttcagtaaacgacccagggtggttcccagcaaagctgcttcctctctgctcctacgcatcctgtcctggcgggaagagagcgtctgggtccattcaagactctgatgacacccctccccgaggcctcccactgccggggtcccaggacccttcccccttcacctggtgacaggaacactcctttcctggtatggaacgtgagctcccgtgacatgatgataggtcttctccttggggcctcccccaataaatctgtaataaacctgaaacccacctacagctacctggaagtca

SEQ ID NO: 1773 - DNA, 2076 bp, Homo sapiens
gtcaccctgccacccagtgctcacaccctctggccagtgcctggctatggcccgactgctcaggtctgcaacctgggagctgttcccctggaggggctactgctcccagaaggcaaagggagagctctgcagggacttcgtagaggctctgaaggccgtggtgggcggctcccacgtgtccactgccgcggtggtccgagagcagcacgggcgcgatgagtcggtgcacaggtgcgaacctcctgatgctgtggtgtggccccagaacgtggagcaggtcagccggctggcagccctgtgctatcgccaaggtgtgcccatcatcccattcggcaccggcaccgggcttgagggtggcgtctgtgctgtgcagggcggcgtctgcgttaacctgacgcatatggaccgaatcctggagctgaaccaggaggacttctctgtggtggtggagccaggtgtcacccgcaaagccctcaacgcccacctgcgggacagcggcctctggtttcccgtggacccaggcgcggacgcctctctctgtggcatggcggccaccggggcgtcggggaccaacgcggtccgctacggcaccatgcgggacaacgtgctcaacctggaggtggtgctgcccgacgggcggctgctgcacacggcgggccgaggccggcatttccgcttcggcttctggccagaaatccctcatcacacagcctggtactcaccttgtgtgtccctgggacgtaggaagagtgcagccggctacaacctcacggggctcttcgtgggctccgaggggacgctgggcctcatcacagcaccaccctgcgcctgcaccctgcccctgaggccacagtggccgccacgtgtgcgttccccagtgtccaggctgctgtggacagcactgtacacatcctccaggctgcagtgcccgtagcccgcattgagttcctggatgaagtcatgatggatgcctgcaacaggtacagcaagctgaattgcttagtggcgcccacactcttcctggagttccatggctcccagcaggcactggaggagcagctgcagcgcacagaggagatagtccagcagaacggagcctctgacttctcctgggccaaggaggccgaggagcgcagccggctttggacagcacggcacaatgcctggtacgcagccctggccacgcggccaggctgcaagggctactccacggatgtgtgtgtgcccatctcccggctgccggagatcgtggtgcagaccaaggaggatctgaatgcctcaggactcacaggaagcattgtcgggcatgtgggtgacggcaacttccactgcatcctgctggtcaaccctgatgacgccgaggaactgggcagggtcaaggcttttgcagaacagctgggcaggcgggcactggctctccacggaacgtgcacgggggagcatggcatcggaatgggcaagcggcagctgctgcaggaggaggtgggcgccgtgggcgtggagaccatgcggcagctcaaggccgtgctagacccccaaggcctcatgaatccaggcaaagtgctgtgaagggggtctgagcacttagcccacaagttccctgactacggagccggttctggaacttttcttcatgccacggcccctgcaaggaaatagatgctgaggcagtcttcctgccagcgagcccactgtatctgggcccaaggccagagggcccagagagaagcctgagcaccgtgttacctccctggccctctggctggccccaggagcctttggttcagtaaacgacccagggtggttcccagcaaagctgcttcctctctgctcctacgcatcctgtcctggcgggaagagagcgtctgggtccattcaagactctgatgacacccctccccgaggcctcccactgccggggtcccaggacccttcccccttcacctggtgacaggaacactcctttcctggtatggaacgtgagctcccgtgacatgatgataggtcttctccttggggcctcccccaataaatctgtaataaacctgaaacccacctacagctacctggaagtca

SEQ ID NO: 1774 - DNA, 920 bp, Homo sapiens
ggctggtaccgtccgggagtttgggatccagtgcctggctatggcccgactgctcaggtctgcaacctgggagctgttcccctggaggggctactgctcccagaaggcaaagggagagctctgcagggacttcgtagaggctctgaaggccgtggtgggcggctcccacgtgtccactgccgcggtggtccgagagcagcacgggcgcgatgagtcggtgcacaggtgcgaacctcctgatgctgtggtgtggccccagaacgtggagcaggtcagccggctggcagccctgtgctatcgccaaggtgtgcccatcatcccattcggcaccggcaccgggcttgagggtggcgtctgtgctgtgcaggtacagtggggctccctcgcccggcccgaggatggtcccagcacaccttggcacacctgtggctgcctcccccgccacacacggcaccttgggtctgctcccgcccgtgggctgcctgcctctgggggtctggtctggctgctggggggacacccgcggggtgtggtccggggacgtggccaggtcagagacccaggtctgcagtggtcttagcacctgccccaaccagggcggcgtctgcgttaacctgacgcatatggaccgaatcctggagctgaaccaggaggacttctctgtggtggtggagccaggtgtcacccgcaaagccctcaacgcccacctgcgggacagcggcctctggtttcccgtggacccaggcgcggacgcctctctctgtggcatggcggccaccggggcgtcggggaccaacgcggtccgctacggcaccatgcgggacaacgtgctcaacctggaggtggtgctgcccgacgggcggctgctgcacacggcgggccgaggccggcatttccggtgagcgccctctgcggggggc

SEQ ID NO: 1775 - DNA, 375 bp, Homo sapiens
ggaagaaaagactcaaggcagtcactggatcaagccacagggaggttttagtaaccttgctaagactgactccgaggagtgctgggtggatgcagaaaggaagggaggaagacagcgtcacagagacagtgaatgcgagctactctccaaagactgcagctgagaaagaaggacagatggaggggcaggtgaggtcaaggaaagttcttaattacgctgccatctttaaaaattgaagtaaattgtatttgtttatatggtgatgggtaggaggctatagaagaaaggctgaaggaacagggagagtgaataactgataagagtggagtttctgaaaaggcaagataccatggaaggcattggccttggacagaa

SEQ ID NO: 1776 - DNA, 461 bp, Homo sapiens
ggtcaggaaagatggtttggtttctttcaacctactgctttttgaaggctcagggccaaaagaaaaggaaagtagaatgatagggattttgttatttactatacttaactgaataagtctgcagatgtctggaactatcctgtataaaacatcctattcaccagttcctaagagaccctcaaagagacaattcgagtttaacgcataaaatatcaaagtgggccagacgcagtggctcacgcctataatcccagcactttgggaggcagaggcagatggatcacttgaggttaggagtttgagaccagcctggccaacatggtgaaaccctgtctctactaaaaatacaaaaattagctgtgcatggtggtgggtgcctgtaacccgagctacttgggaggctgagccaggaaaatggcttgaacccaagaggcagaggttgcagtgagccaagattgtgc

SEQ ID NO: 1777 - DNA, 463 bp, Homo sapiens
gttttgaaatatttgaattataaacttagccattgagcatcctaatccaaaaattctaaatctgaaatgcgccaatgaacatttcctttgaatgtcatgtgggggcttgaagttttgggttttggagtgtttctgattctcagatttagggatactcaacctgtacttagatatggatctaggcagggcgcagtggttcacacctatactcccagcactttgggaggccaaggtgggagattgcttgaggccaggagttcaataccagcctggccaacatggggaaaccttgtctctactaaaaatacaaaaattagctgggtgcggtagtgcatgcctgtaatcccagcttcttgggaggctgggacacgagaattgcttggacccaggaggcagaggttgcagtgagccgagatcactccactgcactccagcctgggtgatagagcaagattctatctcc

SEQ ID NO: 1778 - DNA, 476 bp, Homo sapiens
ggctcccaataggcagtgtgcccagagtagcagctcggaagcagtactgcaatcacatttatacccactttcaactatatgcaaatttaggggtggattatgccaaaatttctagaaaaaaggtcgtaacttccaggtcgtgggattgttgctatggaaaggagccaaaacttccagctgttgccttagcaatggtaacctgacgtggcactggtgagtgtgttttatggagagactctttcacctcttccctttcagcttgtcttcagtgtggtctggagcccaatccccacctccagagtctagtcctgcctcctacctcagtaataaaaagtagtagtatatggttaattgtcaaatacatttgcaaagtgtaatcaaagatacattaccaatctgaatctcaaaatgtgctatcatctttgaatttgaataatgtattattaaagaagttacagttttcctttacattcaat

SEQ ID NO: 1779 - DNA, 417 bp, Homo sapiens
tattcttatatattttcttagctaatgattatagtcttcataattacctactaaacaagcttgtttataaaatctatcactctagatgataaatctacattaaatggtacttgctcataattaaaatatctagtgagtgcatatgttgaacagtggtagttttgaagatgtggttgcaatctgtagattctgaacttcttcactatctcttctccaatagatgaattctgctaatagcccctaggatagtaagtgttactgtattagcaaagcagcctagcatattccccttgatttggtcatctcttaaaaaacactggatgcttgtaagaaattaaacttttgtgtaccatatgaagggcctcataaagtatctgaaggagtaaaaatgaaagccaaactccaggcttttttttt

SEQ ID NO: 1780 - DNA, 446 bp, Homo sapiens
tgtacaagaaagcaagcaatatggtttaaaagaacaattttagcatcaataagaataactgcaatgggctggttgcagtggctcaccattatcccggcactttgggaggccgaggcgggcggatcacttgaggtcaggagttcgagaccagcccagccaacatggtgaaaccccatcttgacaaaaataccaaaattagccaggcatggtggcacatgcctgtaatcccagctactccagaggctgaggcatgagaattgcttggacccaggaggcagaggttgcagtgagccaggatcgcaccattgcactccagcctgggcgacaaggagagacttcatcttaaaaaataaaacaatataactgcaacggatcaaaatgcaccaaatatgtttaaattcatgagttcataatgaagctaaaaaaaactttccgtcattggatac

SEQ ID NO: 1781 - DNA, 414 bp, Homo sapiens
cagaagaatgaagggttatgtgatatcctattcccagagggtgaggaaggcagaccacctaatgacctggccccgtggaatttggcctccctgcttcgtggcacttattcagcagtgctccactgtggaagcagggtgtggctgggtctggcattaagtagtgacagccctctggggcagaaccacacatctaagaatggactaagccagtcacaagtctcacttctttggaactccattccagggttcccagagcagttgggaacaccgttctgtaatcaaactgagttcacctttgggcaccagctgctcccacagaccaagggcaggacaaagtacagaaaatagattgaagcaaagtacagaaaagagattgaagcaggtgctgctttctgtgaatttgatccagactgg

SEQ ID NO: 1782 - DNA, 424 bp, Homo sapiens
ggctggtctcaaactcctgacttcaagtgatccaccctccttggcctcccaaagtgctgggattacaggcgtgagccactgtgccctgcccccattgttgtttttacccatgtgaaaacaagtactggggaccaggagctataaataattggatctctgctgacaaccaggcactgttcatggatgggtgggtggatggatggatggatggatggatggatggatggatggatgaataaatagatagaatttaatcttcacaataacccattgagattaagtttcattgtctccatttcacagattaaaaaacaaaacaaaaatgcaaaaccttgaggcccagaaactcaagtgtatctaattccaaagtacctaaaaccatgactaaacagaatgcaggtacccagtgagtgtctgtggaatg

SEQ ID NO: 1783 - DNA, 323 bp, Homo sapiens
ccttcaactgattggatgaagctcacccacattatagagggaaatctgctttacccaaaactactgagttaaatgttaatcccatttataaaaaccttcacataaacatcaagaatgatgttttaccaaatatctgtgtactgtgacctagccaagttgatacataaaattaatcatcattgtagattttaaaagtttccttatactactagttcattaaaaggtgtttgttttaataattagtgaatgttaaaattatgtgaaatactttctggacatctgttgagatgatcatatgtttttctcttttatttgattaatat

SEQ ID NO: 1784 - DNA, 1168 bp, Homo sapiens
tgctccatgacagacgtcccaatgaccttgagcaagtcccttggcccctgagtctcagttttctgggtggggtgagtgaggagaactgggagatctttagggtcccttagattcaagtagaatgtgacacagatcccgtgggaaaccactgtgctgtgctgtctcaccttctgaggagagaagaaagagggagaaaaggcagggcatggtggctcacgcctgtaatcccagcactttgtgaggccaaggtgggcagatcacttgagatcaggagtttgagaccagcctggccaacatggtgaaaccctgtctctactaaaaatacaaaaattagctgggcgtggtggtaggcgtctgtaatcccagctactcgggaggctgaggcaggagaatggcttgaacccaggagacggaggttgcagtgagctgggagcgtgcaccactgcactctagcctgggtgataagaacaaaactcagtccaaaaaaaaaaaaaaaaaaaaagagggaaagagggagaaaggattgggaggagaaaaggagagcaaagaagaagagaagaatagagagagtgagctgagaatttgagcttgctcagagttgactttcgggagggtttttgtcctataatatgtggcatcctgtgggtgacagggaggtgagttaggtggacacgtataggacgtgccctttcataaggcttgggcagtcatttggcgagtgagctgaaatccatgtcttgttagagatagggatggggtaggcagaaaggagctccaaactatgggtttgggattggcacccctatcctatcatcacccagagtcttcattgttgagatgctgcccatggaaaacagattgggacatagattttggaatcaaggtctctgctcctggcatctcctctgtgcgtctccctctgcctttgctccctggggactgtgggcaggaggagcttcttcggaggaccgggagtgggcctccagtccccctgcccctgtagaggaataatgagggaggacatggggaagtcactgtcaaaggctggcacagctgtgagcccaatgcctctgagcgaaaaggagagagagggagttcacgcccctgagagtagccccctgagccggctgggacctggactgcctgctttcctcctgcctcttcccct

SEQ ID NO: 1785 - DNA, 1148 bp, Homo sapiens
ccatttttcatatattatcttacgttttaaatttaattttaatgtgttttctgttcacaaaaatagtgtgtgattacagtcaattcatttttatcaagagagccaagacaattcaagaggaaaagaatagtctttgcaacaaatggtactggaaaaactgtatatgcagttcgatgaaagaatgaaattagactcttgattcatagcctgtgcagaaattaactcaaaatttgattttaaatgttaagagctaaactacaaaactcaaaacatacagataaatctttacgacttagattaggcagtagtttcttagatatgacaccaacagcataagcaacaaaggaaaaaatagatataggttgactatcccttatccaaaatgcttgggaccagaagtatttcagatttcagattttttcagattttggaatatttgcattatacttaacagttgagcacctctaatctgaaaatccaaagtccacagtgcttcagtgagcatttcctttaagtgtcatctcagggcttaaaaagttttggattttggagcattttgctcttcagatttttggattaaagatagtcagcctgtaattgaatatgtcatcaaaaggattaaatgaatctttgctgttccatttaaaattttttgtacacagttatttccaacagataatatatagctggttggcatctcttaattctgaatattcacttttctataccatattagtataatacctttcatatagtagaggcttttaaaatgttattaatgagtttaaagaaatgtgtttgttccatttttgcctattaaactatttaaaattcaggccatcttagaaaagtaattgttgggctgggcatggtggctcaagcttgtaatcccagcactttgggaggtctaggcaggcagatcacttgaggtcaggagttcgagaccagcctggccaacatggcaaaaccccatctctactaaaaatacaaaaaaaatttatctgggcatggtggtgcacgccagtaatcccagctacttggaaggctgaggcatgagaattgtttgaacctgagagacagaggttggagtgagccaagattgtgccactatactccagcccggacaacagagcaagactcggtctcaa

SEQ ID NO: 1786 - DNA, 453 bp, Homo sapiens
ataaatgaaaattcatcttagtttcattagtttcatcagctctaatcttataataccttatatgatcatataatactatatctcctcactaaaatacaaggaaagttatagtttgatatttactttaagcttctttgaggaaaagtattgtacatgtacaaaggagtatcaagatagagatgcaatcatggtatctatcctctagttgcctgttatgttatgttatgttatgttatgttatgttatgttatgttatgttatgttatgttattttgatggagtctcactgtcgctcaggctggagtgcagtgacatgatctaggctcactgcaacctctgcctcccggcatcaagtgattctcctgcctcagctacctgggaggctgaggcagagaatcgcttgaacccgggaggcagaggctgcagtgagccgagattgtgccactgcactcc

SEQ ID NO: 1787 - DNA, 422 bp, Homo sapiens
taaatgaataaaaaagacagatccaaatgaatccaaattgagatagattgcaatcaaactttgaaaatatagacaaagaaaatcttgaaaatagccagggaaagataatgtattgcccactgcattccagcactctggggggccaaggcgggcggatgacgaggtcaggagttcgagaccagcctgactaacttggtgaaaccccatctctactaaaaagaccagcctgactaacatggtgaaacctcatctctactaaaaatacaaaaattagccaggcatggtggcacacacctctagtcccagctactagggaggctgaggcaggaaaatcgcttgaacccgggaggtggaggttgcagtgagccgagatcactccactgcacttcagcctgggtgacagagcaagactccgtctccaa

SEQ ID NO: 1788 - DNA, 477 bp, Homo sapiens
tgaccccatgacctagatgatgtgaccctctttttctgcctcagccttcacaataggaggattttgacacaatgctgagcccagcactcagaatatgttactctcctctttttgctgaaccatgcccacaaaaaaggaatttggacctattgcagggcccagcatcgagatgatgttactcttctgcctgggttctgcaaaagaggaaattgtggcatattgcatatttcttggcccagcattcttatgatgtgactctcctgcctgtgctgggagccaccgaatgtattttgacatatcttgggacccattatgtaggtgttttgggctcttataacttgggctggggttttttccacgtgagatgggtgttcatatttgctggggtccagcacccagttattgtgggcccaattttcctataccctggcctaggagaaagcattgtgttcatgttgcttgggcccagcacctaag

SEQ ID NO: 1789 - DNA, 306 bp, Homo sapiens
atttggtatcaatacatccactattgtcaatttcaagctaccagcataatgtattgtaatggcaaaaactgcaattacttttgcaccaaccgaataatggcactgaacaggaagttgaaaagatgtgcggtagtccctcaatagatagtatttccaccataaggattgaatcggggaaaataacttcaagagaataaatcgtagtaaacactatgacaataaacaggaaatgaattagagcatttattatgttttgagaatataatttgttttttaaaataatagctatgtttaacaaacagatgg

SEQ ID NO: 1790 - DNA, 435 bp, Homo sapiens
tgattagttggtgaaaaaaataacttaaagtgtattataggtaataaaattctgtaaataccatttttaataatcactgcaaaatgaagtaaagtttatttagcataaaagcagtaggaaataaatgttatgtttaaggaatgagaagacactcaaagtaggtagccttttgaatgaaaatgaatgaataaactaattccttaataagggaaattataaatgttctttgatttgcaagtaacttctagaaaattgtccaaccctttgttcacagtataattaaaaataagaaattataaatattctttgatttgcaagtaacttctagaaaattgtccaaccctttgttcacagtataattaaaaataagaaagtattaggttctttttctgactttcctccaaactgaaagttaaatgtctctaaaaaatagaa

SEQ ID NO: 1791 - DNA, 335 bp, Homo sapiens
ggaagggaagggaattttccaggatataaactttgttggggcacagagaacaataccacaacgcatgactttttggcatgctgagcactttgaagtaagaaaaattggaaggccttaatagctgcttaactttctaaccttctcttgtttctcttcccacaaccccagtgcagagggaggctgtttctgaaattttcttatctgactaaggaaacttatttccaaaagaaatgcaattgtcttaagaccccctcctcaggaatctcatcaaataaccaggaaaggttaaccactggagaagaaactaaaagtcatcaccatgcccaaacaggatt

SEQ ID NO: 1792 - DNA, 390 bp, Homo sapiens
gggaagctagggagttgggaggtgatagctaaggggcacaaggtttctttttgagatgatgaaactgttctagaaggtgatggatgattgtacaactctgtgcttgtctgggatgattagcagtattctgaactcttgcaccactttttgctgttgctcctcacatcactctatacatttgcccactgtggacattccatataaacagaatcatataacacatggaattttgtgactggcttctttcgtttagtttgtttttaaggttcattcatacatgtagcgtatatcagtacttcattcctttttatggccaaataatattccattatatggatataccatattttgtttacccattcatcaactgatggccatttgggttgttcc

SEQ ID NO: 1793 - DNA, 1637 bp, Homo sapiens
aatgtgttgggaaaaaggcctctgtcccggaagagtcatgggaggtgaaaggggcacgtttgaagatgcgagcgctatcttcacatagttctccagttgtatggagcctcttctgccaagagagggccatgcaattcatcccagaggaacctgaggcctgaaggaggtgagagaagacctctgtgaggaaagcacacagtcaccttctcggcaactaagcagtccctgagaccatttaacatgcaacccgaaggttatggtcaatcccaaaagtcaccactccattcccaactaggacattaccaaagtgacctacccagagattgcttctcatccccagtcccaatgcacatccattcccaagaaatgctttgtcttcagcctctccaggcaccatctcccttcctgtgggagcagagagcttagcctggagcacctttccttcaagccagcaacacagagcactaggttcaattccctgaaggtggccactttaagagagaaatctgaaaaccccatttgctttcttttctcccatattggcatggatttctgtcttctctaacaccttgtgaccttctctatatcatgctttaaagtgtaataatatgattttttaaaagaaatttattacttgttgcaaaggtctttttaaaccagtttagatttcaagaaaaaataaatggaaatcatcgaaaattcatttcacattaatggtctaaaaataaaccaaaggacattatgtgtgcatgtgtgtataagtgcacacagaaatatatatacatatgtagactatatacatgtgtgtatatatgtgtatatatacatacacttgtataaatgtatatacacatatacctataatgtgtgtatgtgtatttattgaagaaacagataccatactcatttctaaaagaatattcagagaatatcaagatgattctggctgaaaaaggccagtggaaattcaggtgaaaatgttcatcaattcccattgcatcacctctgtaatttttcagctctctgtataaacattaaatgtcttatatagcagcaaaaatataaaatagttgtccatattttcacaggtgtggtgtaatttataaaattagaaagcaacttatcagctacttaagagaaatggcaagttttgatatgagtatacaatatataaaaatatatatagtgctatatatataaatatttggtctctatttcattttttgcatcagtattaatactaaaatatgtctcgctagtgatgtttttatgatatccctgatcctaactgaagagacagttatttatagtcatttattttaaaaaatgaaaataagtgaataataattaggttaacattgttgctccctgtgacaaaattttataagcaaatttcaaaagacatgttgtaaattaggaggctcaacaataaaacattatgctccagaaaaaaaaaaaaaacgcataccacccgggccccttgggctcacaggagcagctgattcgcgttgttggtaggctgggccctgggggcactcattaggcatcacaggttgcaagcaatccctgcttgctaacacaaggcccgttggcactttgggcctccaactttaagccaagggctcaacttgaacaaa

SEQ ID NO: 1794 - DNA, 598 bp, Homo sapiens
ccttccatgagagggaaaaatagtccctttgtatgtcttaattatgtagaaaatagtcatgtctttttaaataaaatgaaataatttatcttgctttctggaaaaaatatgaaacaggtaattctgtatgtttcaatatatctcatcaattgcatatatttaatttattgctaattagtacttggtccctcagtattccccattgtcattgacatatacaacatattagcttgaacattgagctatgaggtcaggagcttttgtgggccaggtagtttgttcttagtctctagctccagcccactgcctttcacgttcacactgagagtggggagatcatcactacccaaaagaagttcaaataaataagttaaacaaaggagagccactgtctcgtcatcactatggaccttgggatgccacatctgcacaaacaaagcaatttaaatttttaatgtgactgttttccctgaagtaaactggcataggcaaaatccagtaaattcttattgaacttacttagctacagttgatgtcctcttatatttgtgaaaatctgaaacacaagataaatgtgaaatacaagaatcgtatgggg

SEQ ID NO: 1795 - DNA, 558 bp, Homo sapiens
gaccagatggattcacagctgaattctatcagacattcaaagaagaattggtacaaatcctactgaaacaattccaaaagataaagagggaatcctccttaaatcattatgtgaaaccagtatcaccctaataccaaaaccaggaaagggacataacaaagaaactgttgactcgctctttctgtgtttctctctgccccgtgctgtctcccctgcagtctctgcagtccaggccctcttctctctctatgatctctttgcactctgtctgtttctctgttctgtctgcctctgctcacccacacgtgcacttgtgccccacatgccccaccctcgttctctctggttcccactgtgtctgttgtgtgtctctattcttcttctgattactctttcctcccccacccttatctctttaatgttattgctatgtttgtctctgtgctttctctgtgtgttttcactctttttctttcctgtctcccttctgcagttctgtttcttggtgtctggttgtcttctggtgggggagaagggatagtttactattgtcagtac

SEQ ID NO: 1796 - DNA, 740 bp, Homo sapiens
atttacaaatcccagaaactaagtgaaaccaagcaggataaatacaaaaaataaaaaaatcacaactagaaataccatagtccagttgctggaaacaaaatatgcagagaaaaataaaagcagcctaagaaaaaaggcacagtgcataaagggaaactatgatagctgagtccttatcagaaacagtgaggacctgaagacaatggaacttctttcagggtactaaaaaaaaaaaaaaaaattagcctaaaattctgtaagcaaagaaaaagatcctttaaaaactaggattaaataaagacaatttcatataaacaaatatgaaaagaattcatctctagaaagcactctagaagaaatgctaatgagtgttcttcaagctgaagggaaatgaatccagatgggagcatgaatctacaggaaggaatgaagaacaccagacatgggccgggcactgtggctcatgcctgtaatctcaacgctttgagaggccaaggtgggaggatcacttgagtccaggagtctgagaccagcctagacaacatgacgaaaccctgtttctacaaaaaaaaaaaaaaaaaaaaaaaattagctgaggatggtggctcatactcttgttccaattacttgggaggctgagactgaggattcctgggcccaggacacggaggctgtagtaagccaagatcacaccactgcactccagcctgggtgatagagtgagactctgtccccctgcc

SEQ ID NO: 1797 - DNA, 343 bp, Homo sapiens
atgtgagattgtgactctaatatacacactcagcctaaaagttaaaggtgtcaccctcaaagatgatgagattgtgtcatatcactgggcctagtaccccaggtgttgagactttaatccttaaaatcctttccatgggtgcattgttacatatcactgcgtcagaatcatatgaatgtgactcttctgcctgggccctgtcaacaggggatattatcacatatctctgggcctatgagctagatgatgtgtctctccagcttgtgccctgggttgtatgtatctcctttctattctggactctgccaagagaggggattattacatatttatgagcccagca

SEQ ID NO: 1798 - DNA, 417 bp, Homo sapiens
tgagagtatctttgattatccagatgggcctaatgtaatcacatgaatccttaaaacagaaggcagaagcagaaatcagagtcaaagcacaaggattaccaaggcaccattgttggcttgaagagaaagaggaccatgcagcaaggaaatagggaccacagtcccacaaccatgaggcactgaattctgccaatacccagtgagtgtggaagaagaccatacgtcccagatgagagctgcagccctggatactacctggattttagcctaatgagaccctgaaaagataaaccaaccacactgtgccagatttctaacctatagaaatagtgagataaatttgtgctttttaaaagtgctacatttttacagcacagtaatttgttacacagcaatagaaaactaataacaactagt

SEQ ID NO: 1799 - DNA, 382 bp, Homo sapiens
caattagaagatgcaagtagccttgtgtgacacccaaggcacctagcatctgatttatacaagcagtgggacagttaacaaatgattcattaagattttctccaggccgggtacagtggcttatgcctgtaatcccagcactttgggaggctgtggcagatggatcgattgaggccaggagttcgagaccagcctggccaacatggcgaaaccacatttctactaaaaatgcaaaaactaaccagtcacaatggcacacacctgtagttccagctacttgggaggctgatgcaggagaattgcttgaacctgggaggctgaggttgtgccactgcactccaacctaggtgacagagccagactttgtctcaaaacaaaaaac

SEQ ID NO: 1800 - DNA, 2026 bp, Homo sapiens
  misc_feature (404)..(404): n is a, c, g, or t
  misc_feature (569)..(569): n is a, c, g, or t
  misc_feature (1480)..(1480): n is a, c, g, or t
acaccctcggattgacgtgcgcacgcgcaccggttaccttcaggagcgccgaagaaggaaagaagaacacagagcccgaggcaaagcttaagtgcttacgcttttgtcgggaggtacagacccagctctgcgagagccaggggaaaaggaagagaggcagggaaggaaaggcagcaagtacaaggtgatgaatgactgcactggccattgcttcatgaagagccacgaaaaaacagagccggtttctcagcaggtagctggctgctcagtcacaaaggacctctttggacaggctttatggaaatactgtgcctaggacagtcgctcaaaggcaggagggagagaaaatgcatccgcaagctcactttgtcttctttcttctgctggtcaaaatttgctggctngggcagttaacgccctcacacatccgagttgtgtcacctggcccctttggtagccactggggaagccagatctaggcatgtggcctgatggctcctgcggtggaaccacatgctcacactcagtcagtcaccactgggatgccctgggcagggcaggctgagtgnctgggagatagctgagcctaagatatctaagcaagcacctgtgatgtatgcactgcagtgtccaaatgtgaaaaagcaagaaagggagatagaagcatatttttttctggagagaaggaggaaaccaccaggagaatacaaacagaaaaaagacatgctcatcatgccctgcaaactcctatgaactggaactacagcagctgttctgccagggacaggttcttctctaaagttccagctctctggagggagaaagccctgactttggatggagttgagctctgtcgcccaggctggagtgcagtggcaccatctcagctgactgtgacctccgcctcctgggttcaagtgattctcctgcatcagcctcccgagtagctgggactacaggtgcacaccaccatgcccggctaatttttgtatttttagtagagacggggttttgccatgatggccaggtttggtctcaaactcctaacctcaagtgatccaccctcctcagcctcccaaagtgctgggattacaggcgtgagccactgcgccccgcctacttgaatttttttttttttttttttttttgagacagagttttgctcctgttgcccaggctggagtgcaacggcatgatctcgactcactgcaacctctgcctcctgggttcaagtgattctcctgcctcagcctcccaaatagctgggattacaggtgcccaccactgtgcctggctgattgtatttttagtagagatggggtttcatcatgttggtcaggctggtcttgaactccagacctcaggtgatcggactgcctcggcctcccaaagtgctgggattacaggcatgacccactgtgcccggacctgcttgaatttttatgatgagcatgttggcagatcacgactgccagctccntgacagcaagaaccttgtatgactttttcatgatggatgttcatctgtgccatctgtaaatattgaataaatatttgtggaatacatgaatccaaaagtgaatggaatgataaagagggaaaggatcatgacatctactacagcatttggcacagacccagctgtctgcagtactatcaagagatgacatggacttcaaggatcaaacaggggagaaaaaggcttaaaagaaaaacaagtctccatcaaaggtaataaccacaatgagaactatacatagctatgtgcttataggtcttagttcacattcccctcattaaaattatagctcaagaaataaagggctgtttaatgacttgggtatataaatatacttcatttgtatattttttacttgctaaaatctatccaaattggtattacctcaaaccataatcttctactgtattttataattttactttattgccatgtatttttcccactgatgttcacaaattcacaggaaacatcagccatgtactaaataaaatatgaattgaatcg

SEQ ID NO: 1801 - DNA, 412 bp, Homo sapiens
actattacaaagtgatagacgtggggctttaggcattatcaatcggacaaattcctaggaactgcggatattgctcgccacagtatcttatcagttaattgcactcttagaggtgctaagagtcagcttgcacaagttaagtccttgaggaaggggctgccagtgaaaaagccaagataaagtctgtctagctctcttagctaaaagaaagtcaattcaggtagaaacaaggctaagtgattaaaagaaaaggaaagtctaagaacaaagttaataaaaacaaggttaggcattacagatggggttatccttatattcagcacagtgtttgttctgaaacttcgatggagtgctcctagtttgataacttggaccatgccaaataaattgaatttatctttcttaacaacag

SEQ ID NO: 1802 - DNA, 388 bp, Homo sapiens
cagtttgcttgtattgcgttaatggatacctcgacccaaatacatcgaatgtgtggattcaacactgtgaactgtgtaaacccctttcaggtactgaataattagaaatgtcactttatcaccaatttgtcagcaaagggaatagtgaagagactgctgtttgagagaatagtgtaaacgctgatgattgctcctctccgtggctgcagagagtacagagaagagattattctgttttctgttcaagtggctgtattttaatttgcctttctaaaaggaacaaatggattcagactaggatattgaagaaaattactgtagcttttagagtcatatttcagagagctgtttgaaggcaatttaattatctattatcttctcttaatat

SEQ ID NO: 1803 - DNA, 906 bp, Homo sapiens
gccctgttcaaatggttacaaagttcagctagagaattccttctccctgtagagttttaccccctgctcctctggccgccctccggatggatctttgtgttgccaggcaggaatgggctgcttggggacccagtgagctccgagggcctttctgctgcttcctgtacccctgtatttcgctcagctctctgacttgactcagctccagacatctacccctggagaaagagcccaatgagaagtaatctctgaagcccagatttcctaaggatgaagcttcaggagaggccttatcaatcctgacaacaaacttttctcgtcaatttagtttcatttaatggaagttttaaatgtgtaaagttcagaaggctattaaaattggttccagctatctaagatacacacacaaccacacacgcgcacacacggtagagataaatatgttcgaaaatccagctcaatgttactagaaaatttgatcagaatctggtgaaataaatagtaaacttactaaaaatgccaaatatcccagaagctgcttaacatttgatcaaaagctctgtccagtcaattcctgcttctttcaaaaatactctgctgaaaagccaaaggagaaatggggctggtaccttcaatatagagaattccaagtaagattagatcccagaaggcttagtgtggctttctaggactctcactattaggcagtaacctaccattcacctctgtttcccagattcaccttgttataccttataacttaaaatataaattccaacaatgtactgcactcaaaaaaattatttctcaatttgtttgctcatactattgatttttttctagaatctaaataattgtgaattaactatgatagcagtatgcacaaacagtaagtgaaatcagacc

SEQ ID NO: 1804 - DNA, 793 bp, Homo sapiens
agctctctttttgcctgctgccatccacgtaagatgtgacttgcacctccttgtcttctgccacgattgtgaggcttccccagccatgtggaactacatctacccctggagaaagagcccaatgagaagtaatctctgaagcccagatttcctaaggatgaagcttcaggagaggccttatcaatcctgacaacaaacttttctcgtcaatttagtttcatttaatggaagttttaaatgtgtaaagttcagaaggctattaaaattggttccagctatctaagatacacacacaaccacacacgcgcacacacggtagagataaatatgttcgaaaatccagctcaatgttactagaaaatttgatcagaatctggtgaaataaatagtaaacttactaaaaatgccaaatatcccagaagctgcttaacatttgatcaaaagctctgtccagtcaattcctgcttctttcaaaaatactctgctgaaaagccaaaggagaaatggggctggtaccttcaatatagagaattccaagtaagattagatcccagaaggcttagtgtggctttctaggactctcactattaggcagtaacctaccattcacctctgtttcccagattcaccttgttataccttataacttaaaatataaattccaacaatgtactgcactcaaaaaaattatttctcaatttgtttgctcatactattgatttttttctagaatctaaataattgtgaattaactatgatagcagtatgcacaaacagtaagtgaaatcagacc

SEQ ID NO: 1805 - DNA, 816 bp, Homo sapiens
  misc_feature (76)..(76): n is a, c, g, or t
agcggatgctggcgccgtacctggaactcggaggctgggatcgtgattttgcgggctccgcgtctgtgtaccgganggtactaagttcagggcttcccccaggccactgctgtgaactacatctacccctggagaaagagcccaatgagaagtaatctctgaagcccagatttcctaaggatgaagcttcaggagaggccttatcaatcctgacaacaaacttttctcgtcaatttagtttcatttaatggaagttttaaatgtgtaaagttcagaaggctattaaaattggttccagctatctaagatacacacacaaccacacacgcgcacacacggtagagataaatatgttcgaaaatccagctcaatgttactagaaaatttgatcagaatctggtgaaataaatagtaaacttactaaaaatgccaaatatcccagaagctgcttaacatttgatcaaaagctctgtccagtcaattcctgcttctttcaaaaatactctgctgaaaagccaaaggagaaatggggctggtaccttcaatatagagaattccaagtaagattagatcccagaaggcttagtgtggctttctaggactctcactattaggcagtaacctaccattcacctctgtttcccagattcaccttgttataccttataacttaaaatataaattccaacaatgtactgcactcaaaaaaattatttctcaatttgtttgctcatactattgatttttttctagaatctaaataattgtgaattaactatgatagcagtatgcacaaacagtaagtgaaatcagacc

SEQ ID NO: 1806 - DNA, 960 bp, Homo sapiens
gccctgttcaaatggttacaaagttcagctagagaattccttctccctgtagagttttaccccctgctcctctggccgccctccggatggatctttgtgttgccaggcaggaatgggctgcttggggacccagtgagctccgagggcctttctgctgcttcctgtacccctgtatttcgctcagctctctgacttgactcagctccagaaatattctttcattaatattacatgcttatggaactttacctattgattaaagacatctacccctggagaaagagcccaatgagaagtaatctctgaagcccagatttcctaaggatgaagcttcaggagaggccttatcaatcctgacaacaaacttttctcgtcaatttagtttcatttaatggaagttttaaatgtgtaaagttcagaaggctattaaaattggttccagctatctaagatacacacacaaccacacacgcgcacacacggtagagataaatatgttcgaaaatccagctcaatgttactagaaaatttgatcagaatctggtgaaataaatagtaaacttactaaaaatgccaaatatcccagaagctgcttaacatttgatcaaaagctctgtccagtcaattcctgcttctttcaaaaatactctgctgaaaagccaaaggagaaatggggctggtaccttcaatatagagaattccaagtaagattagatcccagaaggcttagtgtggctttctaggactctcactattaggcagtaacctaccattcacctctgtttcccagattcaccttgttataccttataacttaaaatataaattccaacaatgtactgcactcaaaaaaattatttctcaatttgtttgctcatactattgatttttttctagaatctaaataattgtgaattaactatgatagcagtatgcacaaacagtaagtgaaatcagacc

SEQ ID NO: 1807 - DNA, 231 bp, Homo sapiens
ttataaaagtgttacaataaaggatgctgaaaagaaattttcttccttcttttagacatctacccctggagaaagagcccaatgagaagtaatctctgaagcccagatttcctaaggatgaagcttcaggagaggccttatcaatcctgacaacaaacttttctcgtcaatttagtttcatttaatggaagttttaaatgtgtaaagttcagaaggctattaaaattggtt

SEQ ID NO: 1808 - DNA, 396 bp, Homo sapiens
acatgggagtgtttttaatttgctaccgtctgcttgatcccagatcagagtctaactttttgcattagctcctctgactgggattgaccaactttgtgaaataaaagcctgcccgctgctgcctctgagactcagttattagtacccatggaagggctttaggcagaaagctctcagggaactcagagagagtcggtgaaatcatggctgatgcattcagaggacagaaagccaggcacagagtgttaaatacaacattttctcacccatatgtggaagctaaaaaaagttaatctcaaacagtttttctaatgcactaacttctgggattatcttttcaaaaagaaacaatggaagataatgaaaacaaatggaaatggttagcaagaaaaaaaa

SEQ ID NO: 1809 - DNA, 959 bp, Homo sapiens
gccggaggctggctacactgtcatccttcagatgggcctgtgtgaatggattagggaaccttcaaaaaggtctctcttctggcccaaactgctcaacctggtctgaaaatgtatgtgtgcaatattgcacttcatgatgagatgtgatgttcagggcttctttaataatgcctagaaaaaccttaaaatgggcttggcagatttctttcatttggaggctgtggtactcaactttggtgtttttcattccagactgtaccacattctgtgcccatagtttgaaaaacattttggaagccaatacctgcttgtgtgtagctgcagtcagtttttaaaggttttgctgatgtatattttattttcccctaacctttattaagatcttcaaagttgaaatgactttgcagtggccatctttatccccatcatcaacaggctgccattaatagcattttattctacctgttttattactatctatccatccctccatccatcagtctatcttatttttggatgcatttcaaagtgaatgtagcagatttcaccagttaacttcataatattttatacacttgaagtctagctttttgaacagtacacaaatgtgactaaattgctatagaatgctgttaaagaaggtataaaataaatgccccagttttggaaaaaatttaggagccttattttaaaagtaacaggtattctggaatcctggcatggagttggaaaaaaatatactaatttttaaattggaacttttttgtaactcagacattgctgacccctaaaaaagaggggatacacttgtaaattttattttcatcccaggcaggagttaagtaacttcccgttcttatagagaggcaagatcatcttgaaaagtgttatagacatagaatgttggttacgcccacagaatcaattgcatttggaaggcagaggaacagttaactgag

SEQ ID NO: 1810 - DNA, 822 bp, Homo sapiens
tcccagagaaggaagactcaatgtacatttctctcagaaatatgacaggtctgtgtttttgttggtctggcatatgtttgtctatcttgaacagtctgacaggtaattatttataaaatctggttttgcccagtaagttcatataaaacctttcatttttcatcataagccagtaagctgaatttagaataaagcaaggtcatttatgtctgtcctgaaccagcctacatgtccccataattgctcaatatttttaattcccttttctattttttatacttaggttctttctctgactctttgcacaatactaaatttgaagtgaaataaaacttccttcagcagtgactatagaaacaaaagaaaatttacagaaggaatgtttaagaaaacttcagtaaattattttctcaataatcataatgttagagcagaagatagtcttagagatcattaagaacagctgctcatcttgcaaatgaaaaaaccatggcctagagagggaaagtgagtttcctaagatcactcaataatgtagtgacagaccagagatgagaatcgatggtccctaattttcagtcggtattatacagtattttctaccatactgggttagcataagaatattactaagacatgttggggttttatggcatatttatcctagacaacgatgtaaatttatttaaaaactgtactaattatggatacatcctaaagcatacgtgttatatagtaaaatcttcagtgtgactgtggtattaagtaaacagtctgttatcttacacatcaggcttaactctaagtcaaatggaaatatac

SEQ ID NO: 1811 - DNA, 751 bp, Homo sapiens
cccacatgggtgtgaactacagtaggagttacaaatgccagccatcctaaggacttagccttcatcccagagccagaagcatttcaggatttccaccacctggaaagatattgttattccacttgaaatgggctcttagctgttgcccctttaataatgccagctatgacatggacatgggctgattcgttagtaagataacatactgtcattgctggtgaaaagaccgaaaaagattatgcagattctcctggagtgttacaaagtatgggcctgtctcaataacctgtgctttctgatcctacattgtgaccaagtcccacgaaggctgactgtcaataacaagggaggaaaataggcaggcccaggggtggaagaaaaagagcatcctgccgaaagaaaaaaaaagataggccagaatcactagggaagctttttgtttcataaaggagcatttggttactcttgtttacagatcatttcgtatgtaaagtgtcttaaaaattgcaataacttttattccttagcaaatattctttttgcaaatgcatggctagacattaattcatatattttttaatatttaagaaattcaacacaacatgtattattgatgcaaacccacttgatactagtaaatgctaaacacctaataatatttaataattgaaaataaatttatgggcaaatttatgaacaatttattttaagttgagaaactccagtatctttaaactatgtctatatgtct

SEQ ID NO: 1812 - DNA, 312 bp, Homo sapiens
aatcaggaaagctttcgacaatgaattttatgtatgacttggctgttgacatacaggtgatgtttagggaatgaagtattagactgcatttaccttgttaagtactgaatcttattttaatcacatcacatttcctcttttttttttctaagagatagtgtattgctatgttgctcaggctggaattgaactcagtgggctttagtgatcctcctgcctcagcctcctgagtagctagaactgcaggtgcatgccaccacacccagcttactctttttttgattagcaaactaatgcatattcattaaggaa

SEQ ID NO: 1813 - DNA, 6851 bp, Homo sapiens
gccggagggcgcccgaggggccccgggccgcggcgctcagggcccgggcggccggcggcggccccggggctggggggagtccagcccggatattgagtgcagccattgagaaaagccaaactcttgtgtgtgcgcgtctcgatagcccccaagatggccgccaatgtgggatcgatgtttcaatattggaagcgatttgatctacggcgactccagaaggagcttaattccgtcgcttctgagctgtctgcacggcaggaggagagtgaacattctcataaacatttaattgaactccgccgggaatttaagaaaaatgtacctgaggaaatcagagagatggtggctcctgtattaaaaagcttccaagccgaggtggtggcccttagtaagagaagtcaggaggcggaggctgcttttctgagtgtttacaagcaattaattgaagcaccagaccccgtgcctgtgtttgaggcggcacgcagcctagacgacagactgcagccccccagctttgaccccagtgggcagccccggcgagacctccacacttcgtggaagaggaaccccgagctcctcagccccaaagagcagagagaggggacgtcgcctgccgggcccacgctgaccgagggaagccgcctcccaggcattcccgggaaagccctcctgacagaaaccttgctgcagagaaatgaggcggaaaaacaaaagggccttcaagaagtacagatcactttggcggccagactgggggaggcagaggagaaaatcaaagtcctacattcagcgctaaaggctacgcaggcagagctgctagagctgcggcggaagtacgacgaggaggcagcatccaaggcagatgaagtcggcctgatcatgaccaacctggagaaagctaatcagcgagctgaggctgcccagcgggaggtggaaagtctccgggaacagctggcctctgtcaacagctccatccgcctggcttgctgctctccccaggggcccagtggggataaggtgaacttcactctgtgctcgggccctcggctggaggccgcgctggcctccaaggacagggagatcctgcggctgctgaaggacgtgcagcacctccagagctcactgcaggagctggaggaggcatccgccaaccagatcgccgacctggagcggcagctcacggccaagtccgaggccatagaaaagctggaagagaagctccaggcccagtctgactatgaggaaattaaaacggagctgagcatcctgaaagccatgaagctggcctccagcacctgcagcctcccccagggcatggccaagcctgaagactcactgcttattgcaaaggaggccttcttccccacgcagaaattccttctggagaagcccagcctcctggccagccctgaggaagacccatcagaggacgattccatcaaggattcactgggcacggagcagtcctacccctcccctcagcagctcccacctccaccagggccagaagaccccctgtctcccagccccgggcagcccctgctgggccccagcttggggcctgacggcactcggactttctcgctgtcccccttccccagcctggcatcaggggagagactgatgatgcccccagccgccttcaagggagaggcgggcggcctgctggtgttccccccagccttctatggcgccaagccccccacagcccctgccaccccggcccctggccctgagccactgggcggtcctgagcccgcggatggtggtgggggcggagcggcggggcccggggcagaggaggagcagctggacacggcagagatcgccttccaggtgaaggagcagctgctgaaacacaacatcgggcagcgggtgtttgggcattacgtgctggggctgtcgcagggctcggtcagcgagatcctagcccggcccaagccctggcgcaagctcacggtgaagggcaaggagcccttcatcaagatgaagcagttcctgtcggatgagcagaatgtactggcgctcaggaccatccaagtgcggcagcgaggcagcatcaccccgagaatccgcacgcctgagacaggctcagacgacgccatcaagagcattctagagcaggccaagaaggagatcgagtcgcagaagggcggcgagcccaagacctcggtggccccgctgagcatcgccaacggcacgacccccgccagcacctcggaggacgccatcaagagcatcctggagcaggcacgccgtgagatgcaggcgcaacagcaggcgctgctggagatggaggtggcgcccaggggccgctcggtgcccccctcgcccccggagcggccatcactggccaccgcgagccagaacggggccccggccttggtgaagcaggaggagggcagcgggggccccgcgcaggcgccgctcccggtcctgtcccccgccgccttcgtgcagagcatcatccgcaaggtcaagtccgagatcggcgacgccggctacttcgaccaccactgggcctccgaccgcggcctgctcagccgcccctacgcctccgtgtcgccctcgctgtcctcctcctcctcctctggctactctggccagcccaacggccgcgcctggccccgcggggacgaggcccctgtgccccccgaggacgaggcggcggcaggggcggaggacgaaccccccaggacgggcgagctcaaggctgagggcgcgacggccgaggcgggcgcgcggctgccctactacccggcctacgtgccgcgcaccctgaagcccaccgtgccgccgctgacccccgagcagtacgagctgtacatgtaccgtgaggtagacacgctggagctcacccgccaggtcaaggagaagctggccaagaacggcatctgccagaggatcttcggggagaaggtgctgggcctgtcacagggcagcgtgagcgacatgctgtcccggccgaagccatggagcaagctgacgcagaaggggcgggagcccttcatccgcatgcagctgtggctctctgaccagctcggccaggcagtgggccagcagcctggtgcctcccaggccagtcccacagaaccaaggtcctcaccatccccaccccccagccccacagagcctgagaagagctcccaggagccgttgagcctgtccctggagagcagcaaggagaaccagcagccagagggccgctccagctcctcgttgagcgggaagatgtactcaggcagccaggccccagggggcatccaggagatcgtggccatgtcccccgagctggacacgtactccatcaccaagagggtgaaggaggtcctcacagacaacaatctagggcagcggctgtttggggaaagcatcctgggtctgacacagggctccgtgtctgacctgctgtcccggcccaaaccctggcacaagctgagcctgaaggggcgggagccttttgtccgcatgcagctgtggctcaatgacccccataacgtggagaagctgagggatatgaagaagctggagaagaaagcctacctgaaacgtcgctatggcctcatcagcaccggctcagacagtgagtccccggccacccgctcagagtgccccagcccctgcctgcagccccaggacctgagcctcctgcagatcaagaagccccgggtggtgctggcacccgaggagaaggaggcactgcggaaggcctatcagctggaaccctacccctcgcagcagaccatcgagctcctctccttccagctcaacctcaagaccaacaccgtcatcaactggttccacaactacaggtcccggatgcgccgggagatgttggtggaggggacccaggatgagccagaccttgatccaagcgggggtcctggaatcctaccgccaggccactcccacccagaccccaccccgcagagccctgactctgagactgaggaccagaagccaaccgtgaaggaactggagcttcaggagggccctgaggagaacagcacacccctgaccacccaggacaaggcccaagtgaggatcaagcaggaacagatggaggaggatgctgaggaagaggcaggcagccagccccaggactcaggggagctggacaaaggccaaggtccccccaaagaggagcatcccgaccctccgggtaatgatggactcccaaaagtggctcccgggcccctccttccaggtggatccaccccagactgtccctcacttcatccccaacaggagagtgaggccggggagcgacttcacccggaccctttaagttttaagtcagcctcagagtcctcacgctgcagcctggaggtgtcactgaactcgccctcggccgcctcctcaccaggcctcatgatgtctgtgtcacctgtcccctcctcctcagctcccatctccccatccccacctggcgccccccctgccaaagtgccgagtgccagccccactgctgacatggctggagccttgcaccccagtgccaaggtgaaccccaacttgcagcggcggcatgagaagatggccaatctgaacaacatcatttaccgactagagcgggctgccaatcgggaggaggccctggagtgggagttctgaaggcagggtgagggggcaagggacataccctggtaactaccttccttctcgcacttactctcctcaacaggatggggtaagggagggaggaactcaaccatcaaaatgtggacagcaatgttatgccgtttacgttttttgttgtaatcctagttctatgaagctgtgtgagcaggtgggtcaaatgccattgcctccacttttctgcacccccctgctcctcttcaccctgacccctctgcaggaggcagaagcaaaatggcaccacatattcacctgaaaactccaaactcttttagaaaaataaataaatatttatagacctcttttagatattttaataaaggatcctttggaatttatcccagctgatgctgttttgatattacagagagttataaaatcaggatgctgtcacaactgttgcgaagtatacactgaagttgtgtcgtttttgccactagatgagattaaaagaagacaattattcaaagccatcacaaaacactataagactgaccaaaatttagataacctttgaaccacgatttttttccacatctgtctgtgagacacagcgcaatgctactgcccttccagaaactgtgctaaaaagagaaagtccaaaagactctaaacaaaaacctcgacgccgttgaggatgtgtttcattctggtggtctgttttgcaagcttgataacagaatgtccgtgccattgtaaatgttgtagagatgtgggccgtggcccaaccgtcctatatgagatgtagcatggtacagaacaaactgcttacacaggtctcactagttagaaacctgtgggccatggaggtcagacatccatcttgtccatctataggcaagaagtgtttccagatcctttggaaaggtgggcatggggcaggtgcttggagagtggcgtttgagccagagcgaccccatttcccgtgtgaaccataggcacaacccaggaagtttccccacttgtaggagtgtgggtattccagagcaagactgtggccaccatcttcccctcttggtgttttccgaaagtgacagtgttggtcatcccatgaccactgaagcttagtaaccagcgccaaaaagtagattcatcaaactagagaccccagctccccttctcgccatcttctttctcaagttgaccgtggtgctgtttctggaaggcatctgcaactccaagtccatgcagaactctggaaggccaagttcatcgcagcatgttcaccatatcccagcctccaaatctatcctcctaccttccaacgcatgacctgttggggagcagagacttaacccccaactcagaggaacccttcctccagcgtctttggcatggtttctagggtgagagttcccaatttggatagaacggccaccatattggttactgaatctctctcccttgtttttattacgtttcctttttcaaactgtccatgggaaggctgaattgagtgactccccagaatgaagatgagaaggtgaatataatcaatgccaatgtaatgccagcgggtgagatggccgatggaggtttcaaagatgtagctagcattttgaaaccatatgggcaaaacccggcaaccagaaggggacagataaggaccgttccagaaatcccaactctcacacccagcccaggctgcagtctccacaccaaacagtcaacaaaacacaaaccctgaaggaaaaccttttccatacacccaggctatgcattgaagagttttccactgtatacatttttatccagatgaaggtatttttatattttgacaataggaaacagtgaccattttcagagtaatcaaatctggaacaaatgaaacatcttttagccaccaccaccctgttgcaattaagacaaccgtgggggaacacaccactttttactgttgaaaccaacacaacgttgaaatccaggcttatacgcagactccgattcctagagaactaaatttggctttagtgtgacgggatttgattaagcacttagtatagtcttttgaacacggaaatcctgttgtacttaaagctagcggacccgtgaacaactttgtcaggttcacgtcctataacggttaaaaaacacacacacacatacacaaaccgtttctatgagagattgatgaactttgtttaaaattttaaaaaaaggaacacgttctgtaaacgagtcgctaaatacagaattgtataataaaaaaaagt

SEQ ID NO: 1814 - DNA, 2908 bp, Homo sapiens
  misc_feature (178)..(178): n is a, c, g, or t
  misc_feature (180)..(180): n is a, c, g, or t
  misc_feature (299)..(299): n is a, c, g, or t
  misc_feature (326)..(326): n is a, c, g, or t
  misc_feature (334)..(334): n is a, c, g, or t
  misc_feature (344)..(344): n is a, c, g, or t
  misc_feature (348)..(348): n is a, c, g, or t
  misc_feature (381)..(381): n is a, c, g, or t
  misc_feature (1328)..(1328): n is a, c, g, or t
  misc_feature (2007)..(2007): n is a, c, g, or t
  misc_feature (2203)..(2203): n is a, c, g, or t
  misc_feature (2205)..(2205): n is a, c, g, or t
agctcagtacctcccacccagaccccaaagcacccctgagtggtcaacaggagcccctccccctctggtacatctgagcaagtctcggccctgcttcatggcttccaggggttctcatcgctcctctccacggcccatcggcccctactcactgcaacctcagacttctgggctcaancnatcttcctgcctcagcctcccaagcccagctaattttttaaatttattttttgtagtcccaaagtctcactatgttacccagactggtctcaaactcctggcctcaagtgatcctcccncctctgcctcctgaatagctgggattncaggtgtnagccactgtncccnacctcctttctcttataatgacacttgtcattngattttggggccacctggataatccaggttgatttcatctcaagatccttaattatatcggcaaagacactttggtttttgtttgttttttgttttttgttttttgttttttttaagagacagggtcttgctctgtttcccaggttgaagtacagtggtgcaatcttggctcactgcagccttgacctcctgagctcaagtgatcctcccacctcagcctcccgaatggctgggtctgcaggtgcagccaccatgcccagctcaaagacactttgaataaagtcacattcacaggttccaggcgttaggacacagaggtatccttttggggcggacgttcagccagtacacatgtgcctgctgcctggtcccatgctccaccccatcccgcgctcacaggaacagtccagccacgtgagttttcccagtgatgagagtggaaggaatggcaagagctgatggcacagctgcaggctgtggtccctgcgaggacatggcgctatggcacgaggccgagacagcccatgtgtctgcagctggggtcattatcaccctcactgccggccataacgtactcatggccaagaggcccagtggcaccattccttgccgcctttttgcttataatgtctccgctctcatcagtgatatctagaaaaagacaccctcttatttcccacccttttcgatcctttgggtcccactgtgtcagcgacaaatgacactggaggatgaccctgtacagaccccagagatgcctcccaggggtccccaggcagcgctctcccacggcaccccgtagtacctcagttgtaacacgagggggcagcgctgagatatgcgtgtgctttcaggctcaaagacccagattcaaatcctgtttgtgtcacttactgcgtgactgcagaggaattaattcaccttcctgagctgcagtctcctcttcnataaattgagaataatattagaacctgcctcgtgctgttatttggaggcatcaaggttcacagtatacagcaggtgcttactaagtgttaactattctccttatcatatatgtgtccagctttcctaggagatgtgaaatgcaccaggcctcggactaaatcatactaaattcgtatacccagaacctggtacacagtaggcacctaataattgttgaatattagaaataagactcagcagcaaaaacgggaggaaaggttattggagcaaaaagatacttcatcagtgagaccccccttccatgcacatcttgtgttgtttactcagatagcatttattgagtgcctactgtgtgcccggcacttgctggacactgggaacacagctgtgaccctacaaacacagacatgggcccagccctcagaagcttacctttgagtggcagaagtgaccagatcatcggtcacatagcctgtcatcacagtcacagggggacaccagcatgtctagtgcttgggggtacagacaggcaggaagacaaagggaaacagaagggtcttacggccccccacttggaaacgagccctcattttggggggtgttcttatgggaccctcatctttctggagagaagactgttaaaacagtcacaggccaggggccactcaaggtcccaanattgctgtggaaccttctggaaggtccatataccctctctcctctttccccaaagcccgggagcaggaaggtcattccaagcccagtgctgactccaggagtctgatttcccaactctcctccccagaaatgcaggggcgggagagctgtccccagctgtcaccgacttagagaacaaggagccttaactgatggngncgtaccatacgaacagcccctttagggcctctaattcattttcgagacatttaagcataacaaaatgttttaatgatttcttaggggaattaggaagacatatttttgttctcattaaattttatcctcagacacaagaaccaaatgtcaaatgtgtgttgggcgcttccagcttccccgctcactgccggccccccagctccaaccccctccataaaaataacactcctggaaaattcgctgggacgcgcacactcctgtttttatatttcttgacaggcaaattatttgtcgaaatactcctccccgccacccgaagccacacaagtcctgattcaacatttttgttttgagtgactgctgccaacacagatctttggcagagaatacgacagagcctgatggctcagcaagtattttgataagtgtgcagcctggatgtctgtaattacgaaagaaaaccgtaaatcttttggatattgttcacacagatgtggcgtgaagtgagaaaaaaaaagcagtaaaacgtgttaaaagcataattaatgtcattgttgtgggtgatgatgtgatttaaacctctctgacttctgtattggtgatggctgattcctttatcgcactcgtagagtcactaggtacggacccaagcttcagaaggctaacttgttaactgagtgattagttaaaaggaaaaaaaaaa

SEQ ID NO: 1815 - DNA, 459 bp, Homo sapiens
tactactactaaattcgcggccgcgtcgacgaaacagtgaccattttcagagtaatcaaatctggaacaaatgaaacatcttttagccaccaccaccctgttgcaattaagacaaccgtgggggaacacaccactttttactgttgaaaccaacacaacgttgaaatccaggcttatacgcagactccgattcctagagaactaaatttggctttagtgtgacgggatttgattaagcacttagtatagtcttttgaacacggaaatcctgttgtacttaaagctagcggacccgtgaacaactttgtcaggttcacgtcctataacggttaaaaaacacacacacacatacacaaaccgtttctatgagagattgatgaactttgtttaaaattttaaaaaaaggaacacgttctgtaaacgagtcgctaaatacagaattgtataataaaaaaaagt

SEQ ID NO: 1816 - DNA, 7012 bp, Homo sapiens
  misc_feature (293)..(294): n is a, c, g, or t
  misc_feature (337)..(337): n is a, c, g, or t
cccggaaagccaggttgggtcactgctgggaggtatgaggtgagactcgggtttgcaggcagggcaagttgtggggaggtgggggtggcccctatttgttgggggcagacctgccatttgaaagccaccatcctcatgtgtagccctcacatgggagacaggattggacctgcagggatcctggctgggagcagaacctgcgtcagctcagagtcctgtgggaagggaacggctttatcgcagcctttcgcttttatttttgcacattcgctttttatttgccggtggtgctnntgacgggccctcggagcggggctgtgtctggacacttctgggngccttggacggctctggagaggaggcaggagctgcccaggaaggagcttaattccgtcgcttctgagctgtctgcacggcaggaggagagtgaacattctcataaacatttaattgaactccgccgggaatttaagaaaaatgtacctgaggaaatcagagagatggtggctcctgtattaaaaagcttccaagccgaggtggtggcccttagtaagagaagtcaggaggcggaggctgcttttctgagtgtttacaagcaattaattgaagcaccagaccccgtgcctgtgtttgaggcggcacgcagcctagacgacagactgcagccccccagctttgaccccagtgggcagccccggcgagacctccacacttcgtggaagaggaaccccgagctcctcagccccaaagagcagagagaggggacgtcgcctgccgggcccacgctgaccgagggaagccgcctcccaggcattcccgggaaagccctcctgacagaaaccttgctgcagagaaatgaggcggaaaaacaaaagggccttcaagaagtacagatcactttggcggccagactgggggaggcagaggagaaaatcaaagtcctacattcagcgctaaaggctacgcaggcagagctgctagagctgcggcggaagtacgacgaggaggcagcatccaaggcagatgaagtcggcctgatcatgaccaacctggagaaagctaatcagcgagctgaggctgcccagcgggaggtggaaagtctccgggaacagctggcctctgtcaacagctccatccgcctggcttgctgctctccccaggggcccagtggggataaggtgaacttcactctgtgctcgggccctcggctggaggccgcgctggcctccaaggacagggagatcctgcggctgctgaaggacgtgcagcacctccagagctcactgcaggagctggaggaggcatccgccaaccagatcgccgacctggagcggcagctcacggccaagtccgaggccatagaaaagctggaagagaagctccaggcccagtctgactatgaggaaattaaaacggagctgagcatcctgaaagccatgaagctggcctccagcacctgcagcctcccccagggcatggccaagcctgaagactcactgcttattgcaaaggaggccttcttccccacgcagaaattccttctggagaagcccagcctcctggccagccctgaggaagacccatcagaggacgattccatcaaggattcactgggcacggagcagtcctacccctcccctcagcagctcccacctccaccagggccagaagaccccctgtctcccagccccgggcagcccctgctgggccccagcttggggcctgacggcactcggactttctcgctgtcccccttccccagcctggcatcaggggagagactgatgatgcccccagccgccttcaagggagaggcgggcggcctgctggtgttccccccagccttctatggcgccaagccccccacagcccctgccaccccggcccctggccctgagccactgggcggtcctgagcccgcggatggtggtgggggcggagcggcggggcccggggcagaggaggagcagctggacacggcagagatcgccttccaggtgaaggagcagctgctgaaacacaacatcgggcagcgggtgtttgggcattacgtgctggggctgtcgcagggctcggtcagcgagatcctagcccggcccaagccctggcgcaagctcacggtgaagggcaaggagcccttcatcaagatgaagcagttcctgtcggatgagcagaatgtactggcgctcaggaccatccaagtgcggcagcgaggcagcatcaccccgagaatccgcacgcctgagacaggctcagacgacgccatcaagagcattctagagcaggccaagaaggagatcgagtcgcagaagggcggcgagcccaagacctcggtggccccgctgagcatcgccaacggcacgacccccgccagcacctcggaggacgccatcaagagcatcctggagcaggcacgccgtgagatgcaggcgcaacagcaggcgctgctggagatggaggtggcgcccaggggccgctcggtgcccccctcgcccccggagcggccatcactggccaccgcgagccagaacggggccccggccttggtgaagcaggaggagggcagcgggggccccgcgcaggcgccgctcccggtcctgtcccccgccgccttcgtgcagagcatcatccgcaaggtcaagtccgagatcggcgacgccggctacttcgaccaccactgggcctccgaccgcggcctgctcagccgcccctacgcctccgtgtcgccctcgctgtcctcctcctcctcctctggctactctggccagcccaacggccgcgcctggccccgcggggacgaggcccctgtgccccccgaggacgaggcggcggcaggggcggaggacgaaccccccaggacgggcgagctcaaggctgagggcgcgacggccgaggcgggcgcgcggctgccctactacccggcctacgtgccgcgcaccctgaagcccaccgtgccgccgctgacccccgagcagtacgagctgtacatgtaccgtgaggtagacacgctggagctcacccgccaggtcaaggagaagctggccaagaacggcatctgccagaggatcttcggggagaaggtgctgggcctgtcacagggcagcgtgagcgacatgctgtcccggccgaagccatggagcaagctgacgcagaaggggcgggagcccttcatccgcatgcagctgtggctctctgaccagctcggccaggcagtgggccagcagcctggtgcctcccaggccagtcccacagaaccaaggtcctcaccatccccaccccccagccccacagagcctgagaagagctcccaggagccgttgagcctgtccctggagagcagcaaggagaaccagcagccagagggccgctccagctcctcgttgagcgggaagatgtactcaggcagccaggccccagggggcatccaggagatcgtggccatgtcccccgagctggacacgtactccatcaccaagagggtgaaggaggtcctcacagacaacaatctagggcagcggctgtttggggaaagcatcctgggtctgacacagggctccgtgtctgacctgctgtcccggcccaaaccctggcacaagctgagcctgaaggggcgggagccttttgtccgcatgcagctgtggctcaatgacccccataacgtggagaagctgagggatatgaagaagctggagaagaaagcctacctgaaacgtcgctatggcctcatcagcaccggctcagacagtgagtccccggccacccgctcagagtgccccagcccctgcctgcagccccaggacctgagcctcctgcagatcaagaagccccgggtggtgctggcacccgaggagaaggaggcactgcggaaggcctatcagctggaaccctacccctcgcagcagaccatcgagctcctctccttccagctcaacctcaagaccaacaccgtcatcaactggttccacaactacaggtcccggatgcgccgggagatgttggtggaggggacccaggatgagccagaccttgatccaagcgggggtcctggaatcctaccgccaggccactcccacccagaccccaccccgcagagccctgactctgagactgaggaccagaagccaaccgtgaaggaactggagcttcaggagggccctgaggagaacagcacacccctgaccacccaggacaaggcccaagtgaggatcaagcaggaacagatggaggaggatgctgaggaagaggcaggcagccagccccaggactcaggggagctggacaaaggccaaggtccccccaaagaggagcatcccgaccctccgggtaatgatggactcccaaaagtggctcccgggcccctccttccaggtggatccaccccagactgtccctcacttcatccccaacaggagagtgaggccggggagcgacttcacccggaccctttaagttttaagtcagcctcagagtcctcacgctgcagcctggaggtgtcactgaactcgccctcggccgcctcctcaccaggcctcatgatgtctgtgtcacctgtcccctcctcctcagctcccatctccccatccccacctggcgccccccctgccaaagtgccgagtgccagccccactgctgacatggctggagccttgcaccccagtgccaaggtgaaccccaacttgcagcggcggcatgagaagatggccaatctgaacaacatcatttaccgactagagcgggctgccaatcgggaggaggccctggagtgggagttctgaaggcagggtgagggggcaagggacataccctggtaactaccttccttctcgcacttactctcctcaacaggatggggtaagggagggaggaactcaaccatcaaaatgtggacagcaatgttatgccgtttacgttttttgttgtaatcctagttctatgaagctgtgtgagcaggtgggtcaaatgccattgcctccacttttctgcacccccctgctcctcttcaccctgacccctctgcaggaggcagaagcaaaatggcaccacatattcacctgaaaactccaaactcttttagaaaaataaataaatatttatagacctcttttagatattttaataaaggatcctttggaatttatcccagctgatgctgttttgatattacagagagttataaaatcaggatgctgtcacaactgttgcgaagtatacactgaagttgtgtcgtttttgccactagatgagattaaaagaagacaattattcaaagccatcacaaaacactataagactgaccaaaatttagataacctttgaaccacgatttttttccacatctgtctgtgagacacagcgcaatgctactgcccttccagaaactgtgctaaaaagagaaagtccaaaagactctaaacaaaaacctcgacgccgttgaggatgtgtttcattctggtggtctgttttgcaagcttgataacagaatgtccgtgccattgtaaatgttgtagagatgtgggccgtggcccaaccgtcctatatgagatgtagcatggtacagaacaaactgcttacacaggtctcactagttagaaacctgtgggccatggaggtcagacatccatcttgtccatctataggcaagaagtgtttccagatcctttggaaaggtgggcatggggcaggtgcttggagagtggcgtttgagccagagcgaccccatttcccgtgtgaaccataggcacaacccaggaagtttccccacttgtaggagtgtgggtattccagagcaagactgtggccaccatcttcccctcttggtgttttccgaaagtgacagtgttggtcatcccatgaccactgaagcttagtaaccagcgccaaaaagtagattcatcaaactagagaccccagctccccttctcgccatcttctttctcaagttgaccgtggtgctgtttctggaaggcatctgcaactccaagtccatgcagaactctggaaggccaagttcatcgcagcatgttcaccatatcccagcctccaaatctatcctcctaccttccaacgcatgacctgttggggagcagagacttaacccccaactcagaggaacccttcctccagcgtctttggcatggtttctagggtgagagttcccaatttggatagaacggccaccatattggttactgaatctctctcccttgtttttattacgtttcctttttcaaactgtccatgggaaggctgaattgagtgactccccagaatgaagatgagaaggtgaatataatcaatgccaatgtaatgccagcgggtgagatggccgatggaggtttcaaagatgtagctagcattttgaaaccatatgggcaaaacccggcaaccagaaggggacagataaggaccgttccagaaatcccaactctcacacccagcccaggctgcagtctccacaccaaacagtcaacaaaacacaaaccctgaaggaaaaccttttccatacacccaggctatgcattgaagagttttccactgtatacatttttatccagatgaaggtatttttatattttgacaataggaaacagtgaccattttcagagtaatcaaatctggaacaaatgaaacatcttttagccaccaccaccctgttgcaattaagacaaccgtgggggaacacaccactttttactgttgaaaccaacacaacgttgaaatccaggcttatacgcagactccgattcctagagaactaaatttggctttagtgtgacgggatttgattaagcacttagtatagtcttttgaacacggaaatcctgttgtacttaaagctagcggacccgtgaacaactttgtcaggttcacgtcctataacggttaaaaaacacacacacacatacacaaaccgtttctatgagagattgatgaactttgtttaaaattttaaaaaaaggaacacgttctgtaaacgagtcgctaaatacagaattgtataataaaaaaaagt

SEQ ID NO: 1817 - DNA, 5960 bp, Homo sapiens
ggcagagatcgtgcagtgcactccagcctgggtgacagagtgagactccatctcaaagaaaaaaagaagctgcctgtagaccatacaagggaacttattataggcatggtaactggaaggtgattcattaaccagctaaactcaagctggccagaatgggtcagttcaggcagcacccctccaggtaacatcgccacctgttaatgagcctgctacttcaggcctggggttgcaatgactctggaattaatggggttctggggaatggagcagtcattgtcagggaggtaagccgggtcagtgcctcttgaaagacctctcctccagcccgggggctggctgacctcagaccctctccacttgcactgcagcatcctgaaagccatgaagctggcctccagcacctgcagcctcccccagggcatggccaagcctgaagactcactgcttattgcaaaggaggccttcttccccacgcagaaattccttctggagaagcccagcctcctggccagccctgaggaagacccatcagaggacgattccatcaaggattcactgggcacggagcagtcctacccctcccctcagcagctcccacctccaccagggccagaagaccccctgtctcccagccccgggcagcccctgctgggccccagcttggggcctgacggcactcggactttctcgctgtcccccttccccagcctggcatcaggggagagactgatgatgcccccagccgccttcaagggagaggcgggcggcctgctggtgttccccccagccttctatggcgccaagccccccacagcccctgccaccccggcccctggccctgagccactgggcggtcctgagcccgcggatggtggtgggggcggagcggcggggcccggggcagaggaggagcagctggacacggcagagatcgccttccaggtgaaggagcagctgctgaaacacaacatcgggcagcgggtgtttgggcattacgtgctggggctgtcgcagggctcggtcagcgagatcctagcccggcccaagccctggcgcaagctcacggtgaagggcaaggagcccttcatcaagatgaagcagttcctgtcggatgagcagaatgtactggcgctcaggaccatccaagtgcggcagcgaggcagcatcaccccgagaatccgcacgcctgagacaggctcagacgacgccatcaagagcattctagagcaggccaagaaggagatcgagtcgcagaagggcggcgagcccaagacctcggtggccccgctgagcatcgccaacggcacgacccccgccagcacctcggaggacgccatcaagagcatcctggagcaggcacgccgtgagatgcaggcgcaacagcaggcgctgctggagatggaggtggcgcccaggggccgctcggtgcccccctcgcccccggagcggccatcactggccaccgcgagccagaacggggccccggccttggtgaagcaggaggagggcagcgggggccccgcgcaggcgccgctcccggtcctgtcccccgccgccttcgtgcagagcatcatccgcaaggtcaagtccgagatcggcgacgccggctacttcgaccaccactgggcctccgaccgcggcctgctcagccgcccctacgcctccgtgtcgccctcgctgtcctcctcctcctcctctggctactctggccagcccaacggccgcgcctggccccgcggggacgaggcccctgtgccccccgaggacgaggcggcggcaggggcggaggacgaaccccccaggacgggcgagctcaaggctgagggcgcgacggccgaggcgggcgcgcggctgccctactacccggcctacgtgccgcgcaccctgaagcccaccgtgccgccgctgacccccgagcagtacgagctgtacatgtaccgtgaggtagacacgctggagctcacccgccaggtcaaggagaagctggccaagaacggcatctgccagaggatcttcggggagaaggtgctgggcctgtcacagggcagcgtgagcgacatgctgtcccggccgaagccatggagcaagctgacgcagaaggggcgggagcccttcatccgcatgcagctgtggctctctgaccagctcggccaggcagtgggccagcagcctggtgcctcccaggccagtcccacagaaccaaggtcctcaccatccccaccccccagccccacagagcctgagaagagctcccaggagccgttgagcctgtccctggagagcagcaaggagaaccagcagccagagggccgctccagctcctcgttgagcgggaagatgtactcaggcagccaggccccagggggcatccaggagatcgtggccatgtcccccgagctggacacgtactccatcaccaagagggtgaaggaggtcctcacagacaacaatctagggcagcggctgtttggggaaagcatcctgggtctgacacagggctccgtgtctgacctgctgtcccggcccaaaccctggcacaagctgagcctgaaggggcgggagccttttgtccgcatgcagctgtggctcaatgacccccataacgtggagaagctgagggatatgaagaagctggagaagaaagcctacctgaaacgtcgctatggcctcatcagcaccggctcagacagtgagtccccggccacccgctcagagtgccccagcccctgcctgcagccccaggacctgagcctcctgcagatcaagaagccccgggtggtgctggcacccgaggagaaggaggcactgcggaaggcctatcagctggaaccctacccctcgcagcagaccatcgagctcctctccttccagctcaacctcaagaccaacaccgtcatcaactggttccacaactacaggtcccggatgcgccgggagatgttggtggaggggacccaggatgagccagaccttgatccaagcgggggtcctggaatcctaccgccaggccactcccacccagaccccaccccgcagagccctgactctgagactgaggaccagaagccaaccgtgaaggaactggagcttcaggagggccctgaggagaacagcacacccctgaccacccaggacaaggcccaagtgaggatcaagcaggaacagatggaggaggatgctgaggaagaggcaggcagccagccccaggactcaggggagctggacaaaggccaaggtccccccaaagaggagcatcccgaccctccgggtaatgatggactcccaaaagtggctcccgggcccctccttccaggtggatccaccccagactgtccctcacttcatccccaacaggagagtgaggccggggagcgacttcacccggaccctttaagttttaagtcagcctcagagtcctcacgctgcagcctggaggtgtcactgaactcgccctcggccgcctcctcaccaggcctcatgatgtctgtgtcacctgtcccctcctcctcagctcccatctccccatccccacctggcgccccccctgccaaagtgccgagtgccagccccactgctgacatggctggagccttgcaccccagtgccaaggtgaaccccaacttgcagcggcggcatgagaagatggccaatctgaacaacatcatttaccgactagagcgggctgccaatcgggaggaggccctggagtgggagttctgaaggcagggtgagggggcaagggacataccctggtaactaccttccttctcgcacttactctcctcaacaggatggggtaagggagggaggaactcaaccatcaaaatgtggacagcaatgttatgccgtttacgttttttgttgtaatcctagttctatgaagctgtgtgagcaggtgggtcaaatgccattgcctccacttttctgcacccccctgctcctcttcaccctgacccctctgcaggaggcagaagcaaaatggcaccacatattcacctgaaaactccaaactcttttagaaaaataaataaatatttatagacctcttttagatattttaataaaggatcctttggaatttatcccagctgatgctgttttgatattacagagagttataaaatcaggatgctgtcacaactgttgcgaagtatacactgaagttgtgtcgtttttgccactagatgagattaaaagaagacaattattcaaagccatcacaaaacactataagactgaccaaaatttagataacctttgaaccacgatttttttccacatctgtctgtgagacacagcgcaatgctactgcccttccagaaactgtgctaaaaagagaaagtccaaaagactctaaacaaaaacctcgacgccgttgaggatgtgtttcattctggtggtctgttttgcaagcttgataacagaatgtccgtgccattgtaaatgttgtagagatgtgggccgtggcccaaccgtcctatatgagatgtagcatggtacagaacaaactgcttacacaggtctcactagttagaaacctgtgggccatggaggtcagacatccatcttgtccatctataggcaagaagtgtttccagatcctttggaaaggtgggcatggggcaggtgcttggagagtggcgtttgagccagagcgaccccatttcccgtgtgaaccataggcacaacccaggaagtttccccacttgtaggagtgtgggtattccagagcaagactgtggccaccatcttcccctcttggtgttttccgaaagtgacagtgttggtcatcccatgaccactgaagcttagtaaccagcgccaaaaagtagattcatcaaactagagaccccagctccccttctcgccatcttctttctcaagttgaccgtggtgctgtttctggaaggcatctgcaactccaagtccatgcagaactctggaaggccaagttcatcgcagcatgttcaccatatcccagcctccaaatctatcctcctaccttccaacgcatgacctgttggggagcagagacttaacccccaactcagaggaacccttcctccagcgtctttggcatggtttctagggtgagagttcccaatttggatagaacggccaccatattggttactgaatctctctcccttgtttttattacgtttcctttttcaaactgtccatgggaaggctgaattgagtgactccccagaatgaagatgagaaggtgaatataatcaatgccaatgtaatgccagcgggtgagatggccgatggaggtttcaaagatgtagctagcattttgaaaccatatgggcaaaacccggcaaccagaaggggacagataaggaccgttccagaaatcccaactctcacacccagcccaggctgcagtctccacaccaaacagtcaacaaaacacaaaccctgaaggaaaaccttttccatacacccaggctatgcattgaagagttttccactgtatacatttttatccagatgaaggtatttttatattttgacaataggaaacagtgaccattttcagagtaatcaaatctggaacaaatgaaacatcttttagccaccaccaccctgttgcaattaagacaaccgtgggggaacacaccactttttactgttgaaaccaacacaacgttgaaatccaggcttatacgcagactccgattcctagagaactaaatttggctttagtgtgacgggatttgattaagcacttagtatagtcttttgaacacggaaatcctgttgtacttaaagctagcggacccgtgaacaactttgtcaggttcacgtcctataacggttaaaaaacacacacacacatacacaaaccgtttctatgagagattgatgaactttgtttaaaattttaaaaaaaggaacacgttctgtaaacgagtcgctaaatacagaattgtataataaaaaaaagt

SEQ ID NO: 1818 - DNA, 5949 bp, Homo sapiens
ccaggtggtgctacatgctgggccaagggcgctgaggacagatgggctgacatagaagccatggttaggatctggtgtgtactcggtccacttcagcagcgcccgctcaaactggatggaaaccttggtgactgagttggccggcagctgaatcagcatctccaggaggtggggttgcagccggtcctgggcaggctggtagtggatgtaacttggtttgttctccttgcccttggaggtgatggtgagggtgtgcacatacagccgcagataccagggtacggtgtccgaggccatagaaaagctggaagagaagctccaggcccagtctgactatgaggaaattaaaacggagctgagcatcctgaaagccatgaagctggcctccagcacctgcagcctcccccagggcatggccaagcctgaagactcactgcttattgcaaaggaggccttcttccccacgcagaaattccttctggagaagcccagcctcctggccagccctgaggaagacccatcagaggacgattccatcaaggattcactgggcacggagcagtcctacccctcccctcagcagctcccacctccaccagggccagaagaccccctgtctcccagccccgggcagcccctgctgggccccagcttggggcctgacggcactcggactttctcgctgtcccccttccccagcctggcatcaggggagagactgatgatgcccccagccgccttcaagggagaggcgggcggcctgctggtgttccccccagccttctatggcgccaagccccccacagcccctgccaccccggcccctggccctgagccactgggcggtcctgagcccgcggatggtggtgggggcggagcggcggggcccggggcagaggaggagcagctggacacggcagagatcgccttccaggtgaaggagcagctgctgaaacacaacatcgggcagcgggtgtttgggcattacgtgctggggctgtcgcagggctcggtcagcgagatcctagcccggcccaagccctggcgcaagctcacggtgaagggcaaggagcccttcatcaagatgaagcagttcctgtcggatgagcagaatgtactggcgctcaggaccatccaagtgcggcagcgaggcagcatcaccccgagaatccgcacgcctgagacaggctcagacgacgccatcaagagcattctagagcaggccaagaaggagatcgagtcgcagaagggcggcgagcccaagacctcggtggccccgctgagcatcgccaacggcacgacccccgccagcacctcggaggacgccatcaagagcatcctggagcaggcacgccgtgagatgcaggcgcaacagcaggcgctgctggagatggaggtggcgcccaggggccgctcggtgcccccctcgcccccggagcggccatcactggccaccgcgagccagaacggggccccggccttggtgaagcaggaggagggcagcgggggccccgcgcaggcgccgctcccggtcctgtcccccgccgccttcgtgcagagcatcatccgcaaggtcaagtccgagatcggcgacgccggctacttcgaccaccactgggcctccgaccgcggcctgctcagccgcccctacgcctccgtgtcgccctcgctgtcctcctcctcctcctctggctactctggccagcccaacggccgcgcctggccccgcggggacgaggcccctgtgccccccgaggacgaggcggcggcaggggcggaggacgaaccccccaggacgggcgagctcaaggctgagggcgcgacggccgaggcgggcgcgcggctgccctactacccggcctacgtgccgcgcaccctgaagcccaccgtgccgccgctgacccccgagcagtacgagctgtacatgtaccgtgaggtagacacgctggagctcacccgccaggtcaaggagaagctggccaagaacggcatctgccagaggatcttcggggagaaggtgctgggcctgtcacagggcagcgtgagcgacatgctgtcccggccgaagccatggagcaagctgacgcagaaggggcgggagcccttcatccgcatgcagctgtggctctctgaccagctcggccaggcagtgggccagcagcctggtgcctcccaggccagtcccacagaaccaaggtcctcaccatccccaccccccagccccacagagcctgagaagagctcccaggagccgttgagcctgtccctggagagcagcaaggagaaccagcagccagagggccgctccagctcctcgttgagcgggaagatgtactcaggcagccaggccccagggggcatccaggagatcgtggccatgtcccccgagctggacacgtactccatcaccaagagggtgaaggaggtcctcacagacaacaatctagggcagcggctgtttggggaaagcatcctgggtctgacacagggctccgtgtctgacctgctgtcccggcccaaaccctggcacaagctgagcctgaaggggcgggagccttttgtccgcatgcagctgtggctcaatgacccccataacgtggagaagctgagggatatgaagaagctggagaagaaagcctacctgaaacgtcgctatggcctcatcagcaccggctcagacagtgagtccccggccacccgctcagagtgccccagcccctgcctgcagccccaggacctgagcctcctgcagatcaagaagccccgggtggtgctggcacccgaggagaaggaggcactgcggaaggcctatcagctggaaccctacccctcgcagcagaccatcgagctcctctccttccagctcaacctcaagaccaacaccgtcatcaactggttccacaactacaggtcccggatgcgccgggagatgttggtggaggggacccaggatgagccagaccttgatccaagcgggggtcctggaatcctaccgccaggccactcccacccagaccccaccccgcagagccctgactctgagactgaggaccagaagccaaccgtgaaggaactggagcttcaggagggccctgaggagaacagcacacccctgaccacccaggacaaggcccaagtgaggatcaagcaggaacagatggaggaggatgctgaggaagaggcaggcagccagccccaggactcaggggagctggacaaaggccaaggtccccccaaagaggagcatcccgaccctccgggtaatgatggactcccaaaagtggctcccgggcccctccttccaggtggatccaccccagactgtccctcacttcatccccaacaggagagtgaggccggggagcgacttcacccggaccctttaagttttaagtcagcctcagagtcctcacgctgcagcctggaggtgtcactgaactcgccctcggccgcctcctcaccaggcctcatgatgtctgtgtcacctgtcccctcctcctcagctcccatctccccatccccacctggcgccccccctgccaaagtgccgagtgccagccccactgctgacatggctggagccttgcaccccagtgccaaggtgaaccccaacttgcagcggcggcatgagaagatggccaatctgaacaacatcatttaccgactagagcgggctgccaatcgggaggaggccctggagtgggagttctgaaggcagggtgagggggcaagggacataccctggtaactaccttccttctcgcacttactctcctcaacaggatggggtaagggagggaggaactcaaccatcaaaatgtggacagcaatgttatgccgtttacgttttttgttgtaatcctagttctatgaagctgtgtgagcaggtgggtcaaatgccattgcctccacttttctgcacccccctgctcctcttcaccctgacccctctgcaggaggcagaagcaaaatggcaccacatattcacctgaaaactccaaactcttttagaaaaataaataaatatttatagacctcttttagatattttaataaaggatcctttggaatttatcccagctgatgctgttttgatattacagagagttataaaatcaggatgctgtcacaactgttgcgaagtatacactgaagttgtgtcgtttttgccactagatgagattaaaagaagacaattattcaaagccatcacaaaacactataagactgaccaaaatttagataacctttgaaccacgatttttttccacatctgtctgtgagacacagcgcaatgctactgcccttccagaaactgtgctaaaaagagaaagtccaaaagactctaaacaaaaacctcgacgccgttgaggatgtgtttcattctggtggtctgttttgcaagcttgataacagaatgtccgtgccattgtaaatgttgtagagatgtgggccgtggcccaaccgtcctatatgagatgtagcatggtacagaacaaactgcttacacaggtctcactagttagaaacctgtgggccatggaggtcagacatccatcttgtccatctataggcaagaagtgtttccagatcctttggaaaggtgggcatggggcaggtgcttggagagtggcgtttgagccagagcgaccccatttcccgtgtgaaccataggcacaacccaggaagtttccccacttgtaggagtgtgggtattccagagcaagactgtggccaccatcttcccctcttggtgttttccgaaagtgacagtgttggtcatcccatgaccactgaagcttagtaaccagcgccaaaaagtagattcatcaaactagagaccccagctccccttctcgccatcttctttctcaagttgaccgtggtgctgtttctggaaggcatctgcaactccaagtccatgcagaactctggaaggccaagttcatcgcagcatgttcaccatatcccagcctccaaatctatcctcctaccttccaacgcatgacctgttggggagcagagacttaacccccaactcagaggaacccttcctccagcgtctttggcatggtttctagggtgagagttcccaatttggatagaacggccaccatattggttactgaatctctctcccttgtttttattacgtttcctttttcaaactgtccatgggaaggctgaattgagtgactccccagaatgaagatgagaaggtgaatataatcaatgccaatgtaatgccagcgggtgagatggccgatggaggtttcaaagatgtagctagcattttgaaaccatatgggcaaaacccggcaaccagaaggggacagataaggaccgttccagaaatcccaactctcacacccagcccaggctgcagtctccacaccaaacagtcaacaaaacacaaaccctgaaggaaaaccttttccatacacccaggctatgcattgaagagttttccactgtatacatttttatccagatgaaggtatttttatattttgacaataggaaacagtgaccattttcagagtaatcaaatctggaacaaatgaaacatcttttagccaccaccaccctgttgcaattaagacaaccgtgggggaacacaccactttttactgttgaaaccaacacaacgttgaaatccaggcttatacgcagactccgattcctagagaactaaatttggctttagtgtgacgggatttgattaagcacttagtatagtcttttgaacacggaaatcctgttgtacttaaagctagcggacccgtgaacaactttgtcaggttcacgtcctataacggttaaaaaacacacacacacatacacaaaccgtttctatgagagattgatgaactttgtttaaaattttaaaaaaaggaacacgttctgtaaacgagtcgctaaatacagaattgtataataaaaaaaagt

SEQ ID NO: 1819 - DNA, 2430 bp, Homo sapiens
agagagagagagagagagagacaaagtgccgagtgccagccccactgctgacatggctggagccttgcaccccagtgccaaggtgaaccccaacttgcagcggcggcatgagaagatggccaatctgaacaacatcatttaccgactagagcgggctgccaatcgggaggaggccctggagtgggagttctgaaggcagggtgagggggcaagggacataccctggtaactaccttccttctcgcacttactctcctcaacaggatggggtaagggagggaggaactcaaccatcaaaatgtggacagcaatgttatgccgtttacgttttttgttgtaatcctagttctatgaagctgtgtgagcaggtgggtcaaatgccattgcctccacttttctgcacccccctgctcctcttcaccctgacccctctgcaggaggcagaagcaaaatggcaccacatattcacctgaaaactccaaactcttttagaaaaataaataaatatttatagacctcttttagatattttaataaaggatcctttggaatttatcccagctgatgctgttttgatattacagagagttataaaatcaggatgctgtcacaactgttgcgaagtatacactgaagttgtgtcgtttttgccactagatgagattaaaagaagacaattattcaaagccatcacaaaacactataagactgaccaaaatttagataacctttgaaccacgatttttttccacatctgtctgtgagacacagcgcaatgctactgcccttccagaaactgtgctaaaaagagaaagtccaaaagactctaaacaaaaacctcgacgccgttgaggatgtgtttcattctggtggtctgttttgcaagcttgataacagaatgtccgtgccattgtaaatgttgtagagatgtgggccgtggcccaaccgtcctatatgagatgtagcatggtacagaacaaactgcttacacaggtctcactagttagaaacctgtgggccatggaggtcagacatccatcttgtccatctataggcaagaagtgtttccagatcctttggaaaggtgggcatggggcaggtgcttggagagtggcgtttgagccagagcgaccccatttcccgtgtgaaccataggcacaacccaggaagtttccccacttgtaggagtgtgggtattccagagcaagactgtggccaccatcttcccctcttggtgttttccgaaagtgacagtgttggtcatcccatgaccactgaagcttagtaaccagcgccaaaaagtagattcatcaaactagagaccccagctccccttctcgccatcttctttctcaagttgaccgtggtgctgtttctggaaggcatctgcaactccaagtccatgcagaactctggaaggccaagttcatcgcagcatgttcaccatatcccagcctccaaatctatcctcctaccttccaacgcatgacctgttggggagcagagacttaacccccaactcagaggaacccttcctccagcgtctttggcatggtttctagggtgagagttcccaatttggatagaacggccaccatattggttactgaatctctctcccttgtttttattacgtttcctttttcaaactgtccatgggaaggctgaattgagtgactccccagaatgaagatgagaaggtgaatataatcaatgccaatgtaatgccagcgggtgagatggccgatggaggtttcaaagatgtagctagcattttgaaaccatatgggcaaaacccggcaaccagaaggggacagataaggaccgttccagaaatcccaactctcacacccagcccaggctgcagtctccacaccaaacagtcaacaaaacacaaaccctgaaggaaaaccttttccatacacccaggctatgcattgaagagttttccactgtatacatttttatccagatgaaggtatttttatattttgacaataggaaacagtgaccattttcagagtaatcaaatctggaacaaatgaaacatcttttagccaccaccaccctgttgcaattaagacaaccgtgggggaacacaccactttttactgttgaaaccaacacaacgttgaaatccaggcttatacgcagactccgattcctagagaactaaatttggctttagtgtgacgggatttgattaagcacttagtatagtcttttgaacacggaaatcctgttgtacttaaagctagcggacccgtgaacaactttgtcaggttcacgtcctataacggttaaaaaacacacacacacatacacaaaccgtttctatgagagattgatgaactttgtttaaaattttaaaaaaaggaacacgttctgtaaacgagtcgctaaatacagaattgtataataaaaaaaagt

SEQ ID NO: 1820 - DNA, 878 bp, Homo sapiens
gccggagggcgcccgaggggccccgggccgcggcgctcagggcccgggcggccggcggcggccccggggctggggggagtccagcccggatattgagtgcagccattgagaaaagccaaactcttgtgtgtgcgcgtctcgatagcccccaagatggccgccaatgtgggatcgatgtttcaatattggaagcgatttgatctacggcgactccagaaggagcttaattccgtcgcttctgagctgtctgcacggcaggaggagagtgaacattctcataaacatttaattgaactccgccgggaatttaagaaaaatgtacctgaggaaatcagagagatggtggctcctgtattaaaaagcttccaagccgaggtggtggcccttagtaagagaagtcaggaggcggaggctgcttttctgagtgtttacaagcaattaattgaagcaccaggcaaattatttgtcgaaatactcctccccgccacccgaagccacacaagtcctgattcaacatttttgttttgagtgactgctgccaacacagatctttggcagagaatacgacagagcctgatggctcagcaagtattttgataagtgtgcagcctggatgtctgtaattacgaaagaaaaccgtaaatcttttggatattgttcacacagatgtggcgtgaagtgagaaaaaaaaagcagtaaaacgtgttaaaagcataattaatgtcattgttgtgggtgatgatgtgatttaaacctctctgacttctgtattggtgatggctgattcctttatcgcactcgtagagtcactaggtacggacccaagcttcagaaggctaacttgttaactgagtgattagttaaaaggaaaaaaaaaa

SEQ ID NO: 1821 - DNA, 657 bp, Homo sapiens
aaagaaactgagacccagggagaggaagtgacttgcccaggggctgcaataacctgtggcctgggaaagcacctttgcagatgccgtgtctgggactcattccataccaggtggcatgagagttggaacagctcttgccttcagactagccaggcctgaagttaatgtggcagacagaagtatctagaaatgtgtgaaaacctgccagtcccacccagagagcctctctcatcctgccttcatagagcaggaatgttctgactcctctgggggtcccaggcaccccacgagaacccagaacctcctcagaggggcatttcttcctgtcctctcagctcaggagtaaccccagaggctgctatttcttgtccccagcccagacagggctctgtgactggtcttcatagctccaggacagggtccgggactaggaaggcaggacctgaggccctcggaggtctgcctccccaacccctgcctgaaacagtgcagggagaaggtggaagtgcagagtgggctcacctctcgcccacactgtccccttctccccagcgagctgaggctgcccagcgggaggtggaaagtctccgggaacagctggcctctgtcaacagctccatccgcctggcttgctgctctccccaggggcccagtggg

SEQ ID NO: 1822 - DNA, 548 bp, Homo sapiens
taccgagcgcctcccctgggatgggcggtctcacacacccaacgtgcacaccacagccgtgtatactctcagccttcacggctctgtatgaggctggtgttgtgcccattttgcagatgagagaatggagactagaggaggcgaagtcacttgcccacggtcataagcgggggagcgcagagccagttttcaattcaggagtgtctactctgaagccctcgcttcactccggagcccgctggctctatcctcgcaccgagcctttgcgacaagtgcacagggaacgctaaccccagccctcaacgctgcacagaacccggggtgaaacccgcgcagcacgacgcgcagggagtgggggagaagggagccccgatgccagcgccgcaggtgccgcactgttaaatggtgtgccacgggcccgggggtctagggaccgcctggcgagcggcacgtctggctgaggcgaccctcgaggaggccgccgcattcccagcgtgggggtcctcccgggcttgggtgcggggggtcagcaggagagacccttccgc

SEQ ID NO: 1823 - DNA, 248 bp, Homo sapiens
tttttttgtatttttataaaagatggggtttcagcatgttaaccaggatggtctcgatttgctgacctcctgatctgcctgccttggcctcccaaagtgttggtattacaggtggaatcactttttttgtagaatctgtgcaggcacatttctgaggcctacagtgaaaaattgtaggcctcattgaggcctacagtgaaaaattgaatatccctcaataaaaattacaaacaagctatctgtggaaa

SEQ ID NO: 1824 - DNA, 1883 bp, Homo sapiens
ctccttttctcctcctttctcctccccctcccttttttcctccctccctctccccctttccctcgctcccctcctccctccctccccgtctttcttaccccctccctttctctctctctctctctctcactcgttccctaacattaaagagaaaatgctgctatccgtgacttccaggcccgggatttcgacttttggctacaatagaaacaacaagaagccatatgtgtcactggctcagcagatggcaccacctagcccaagcaacagtacacctaacagcagtagtggaagcaatggaaatgaccagctgagcaaaaccaacctatacatccgaggattgcaaccaggcactactgaccaagatcttgtcaagctgtgtcagccatatggcaagattgtttccactaaggccatactggacaagaccacaaacaaatgtaaaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctccctcagcagcacaggcacgtatatgccgacggctgcagctatgcaaggagcttacatctcccagtacacccctgtgccttcttccagtgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgtagcttctcatctatatgaaaaagttttcgatgtattggaattatttgggaatgcttttaaaacaatttgtaattatttctttacaaaccaaaacagaacagaaaggtgtggtgctggaacatcgatgaaggagccctaattactgagcttagttatggacttttttgatg

SEQ ID NO: 1825 - DNA, 678 bp, Homo sapiens
gcctgtgcccttccccacctttgccctcccagaggttggtatgtgggaagcccatctcagttcctgtgccttcttccagcgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgtagcttctcatctatatgaaaaagttttcgatgtattggaattatttgggaatgcttttaaaacaatttgtaattatttctttacaaaccaaaacagaacagaaaggtgtggtgctggaacatcgatgaaggagccctaattactgagcttagttatggacttttttgatg

SEQ ID NO: 1826 - DNA, 504 bp, Homo sapiens
tagatgttgccagattgcgtcgaccaaaggctgtgtcacctcacatttctaccagccatgtatgaaagtacccatttccttccaggcataggtgctactgctcttttaaaattgttcctgtcttgctgggcacggtagctcatacctgtaatcccagcactttgggaggccgaggcaggtggatcacctgaggtcaggagttcgagaccagcctggccaacatggtgaaacctagtctttactaaaaacacagaaattagctgggcatggtggcgggcgcctgtaatcccagctacttgggaggctgaggccagagaattgcttgaacccagcaggcagaggttgtggtgagccgagatcgcgccactacactccagcctgggcgacaagagtgaaactctgtctcaaaaaaaaaacaaaaaaattgttcctgtcttgatgaatgtaaagtacatcgttattttaatttgcatgtcccttactataggtgaatttaaccatttc

SEQ ID NO: 1827 - DNA, 827 bp, Homo sapiens
ggggttttgagcagttctagatagagctggaagagtggaaggaagagaaagggctataagttggggtggtgagggtcttcttccagcaggtggctggtggtctgctctggagaggctgcattccctacatgcctagcatttctggggtatatcaagaaaagaggggagtgaattcttttagaggtataggggggctttgggttattagcagagcctagttcctgaaacctcaaatttcttaagggggagggagaagggcagggacaccagagtagctcattgccttggcattcttagccacaaagtagatcacatctcagggtttgaggagcatgtggataactacctgaaacctctcaatagctctttctccctcccatttctgttacatggatcaaaaaaaaaaagtgtgatctaccatgcattgtctcagaaagaggcgaatgactccgatgtgcagccttcaggagcacagcgggccgaggccttcgtgagggccttcctgaagcgcagcacgccccgcatgagcccgcaggcccgcgaggaccagatgcagcgcaagggcggggtcctcgagtactttacccgccacaagcgcaaggagaagaagaaggccaaggcctctctggcacgccaaggagaggaggtgcggctcttttgcatttaacccgagccgccgagagtacaggctttttctctctcttcatggactcttgagaacagtcatataaggacctgtgcagaggggctcaaggccgaaaccccggcccacgatgagttacgcgccagctcttttggcgaactttacggggctatttatttggggc

SEQ ID NO: 1828 - DNA, 1921 bp, Homo sapiens
ggggttttgagcagttctagatagagctggaagagtggaaggaagagaaagggctataagttggggtggtgagggtcttcttccagcaggtggctggtggtctgctctggagaggctgcattccctacatgcctagcatttctggggtatatcaagaaaagaggggagtgaattcttttagaggtataggggggctttgggttattagcagagcctagttcctgaaacctcaaatttcttaagggggagggagaagggcagggacaccagagtagctcattgccttggcattcttagccacaaagtagatcacatctcagggtttgaggagcatgtggataactacctgaaacctctcaatagctctttctccctcccatttctgttacatggatcataactcttcctctgtctcctgaaaagcctggacctctctgttccttacacctcccacttcctagtgatgctgtttcctctgttccaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctccctcagcagcacaggcacgtatatgccgacggctgcagctatgcaaggagcttacatctcccagtacacccctgtgccttcttccagtgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgtagcttctcatctatatgaaaaagttttcgatgtattggaattatttgggaatgcttttaaaacaatttgtaattatttctttacaaaccaaaacagaacagaaaggtgtggtgctggaacatcgatgaaggagccctaattactgagcttagttatggacttttttgatg

SEQ ID NO: 1829 - DNA, 2039 bp, Homo sapiens
ggggttttgagcagttctagatagagctggaagagtggaaggaagagaaagggctataagttggggtggtgagggtcttcttccagcaggtggctggtggtctgctctggagaggctgcattccctacatgcctagcatttctggggtatatcaagaaaagaggggagtgaattcttttagaggtataggggggctttgggttattagcagagcctagttcctgaaacctcaaatttcttaagggggagggagaagggcagggacaccagagtagctcattgccttggcattcttagccacaaagtagatcacatctcagggtttgaggagcatgtggataactacctgaaacctctcaatagctctttctccctcccatttctgttacatggatcataactcttcctctgtctcctgaaaagcctggacctctctgttccttacacctcccacttcctagtgatgctgtttcctctgttccaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaagattctcgccctgttgcccaggctggagtgcaatggcgtgatctcgactcactacaacctctgcctcccaggttcaagcgattctctcacctctgcctcctgagtagctgggactacaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctccctcagcagcacaggcacgtatatgccgacggctgcagctatgcaaggagcttacatctcccagtacacccctgtgccttcttccagtgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgtagcttctcatctatatgaaaaagttttcgatgtattggaattatttgggaatgcttttaaaacaatttgtaattatttctttacaaaccaaaacagaacagaaaggtgtggtgctggaacatcgatgaaggagccctaattactgagcttagttatggacttttttgatg

SEQ ID NO: 1830 - DNA, 1839 bp, Homo sapiens
ctccttttctcctcctttctcctccccctcccttttttcctccctccctctccccctttccctcgctcccctcctccctccctccccgtctttcttaccccctccctttctctctctctctctctctcactcgttccctaacattaaagagaaaatgctgctatccgtgacttccaggcccgggatttcgacttttggctacaatagaaacaacaagaagcaacagtacacctaacagcagtagtggaagcaatggaaatgaccagctgagcaaaaccaacctatacatccgaggattgcaaccaggcactactgaccaagatcttgtcaagctgtgtcagccatatggcaagattgtttccactaaggccatactggacaagaccacaaacaaatgtaaaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctccctcagcagcacaggcacgtatatgccgacggctgcagctatgcaaggagcttacatctcccagtacacccctgtgccttcttccagtgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgtagcttctcatctatatgaaaaagttttcgatgtattggaattatttgggaatgcttttaaaacaatttgtaattatttctttacaaaccaaaacagaacagaaaggtgtggtgctggaacatcgatgaaggagccctaattactgagcttagttatggacttttttgatg

SEQ ID NO: 1831 - DNA, 2218 bp, Homo sapiens
ggggttttgagcagttctagatagagctggaagagtggaaggaagagaaagggctataagttggggtggtgagggtcttcttccagcaggtggctggtggtctgctctggagaggctgcattccctacatgcctagcatttctggggtatatcaagaaaagaggggagtgaattcttttagaggtataggggggctttgggttattagcagagcctagttcctgaaacctcaaatttcttaagggggagggagaagggcagggacaccagagtagctcattgccttggcattcttagccacaaagtagatcacatctcagggtttgaggagcatgtggataactacctgaaacctctcaatagctctttctccctcccatttctgttacatggatcataactcttcctctgtctcctgaaaagcctggacctctctgttccttacacctcccacttcctagtgatgctgtttcctctgttccaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaagattctcgccctgttgcccaggctggagtgcaatggcgtgatctcgactcactacaacctctgcctcccaggttcaagcgattctctcacctctgcctcctgagtagctgggactacaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggtaaggttttatataatcaagccacctgaaaatgataatggcctgtgtccagacactcaaatgattcatcttgattctctctatttgaaagtcaagggaacgttggctgtgcctatcagttgggacccttcccttgtggtttcctgtgactcagtactgattgaggttccttcccacaggttttacccagccccctataacatcacccccaacaggatgcttgctcagtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctccctcagcagcacaggcacgtatatgccgacggctgcagctatgcaaggagcttacatctcccagtacacccctgtgccttcttccagtgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggccctgctaaggactaacacttagccatcgtttttcacaggcctgggcctggaaaaagaaatctctacgttcctgccctttactattgctgatggagcctgggggaaccatcactttttttgtgtgctacattcaaggagatcaaaaaaacttttcttcttttgcaaagaaagctttttgtttttaactgcaacgtacttttcccctaccttgaagagacatggtggtcgtagcttctcatctatatgaaaaagttttcgatgtattggaattatttgggaatgcttttaaaacaatttgtaattatttctttacaaaccaaaacagaacagaaaggtgtggtgctggaacatcgatgaaggagccctaattactgagcttagttatggacttttttgatg

SEQ ID NO: 1832 - DNA, 1514 bp, Homo sapiens
ctccttttctcctcctttctcctccccctcccttttttcctccctccctctccccctttccctcgctcccctcctccctccctccccgtctttcttaccccctccctttctctctctctctctctctcactcgttccctaacattaaagagaaaatgctgctatccgtgacttccaggcccgggatttcgacttttggctacaatagaaacaacaagaagccatatgtgtcactggctcagcagatggcaccacctagcccaagcaacagtacacctaacagcagtagtggaagcaatggaaatgaccagctgagcaaaaccaacctatacatccgaggattgcaaccaggcactactgaccaagatcttgtcaagctgtgtcagccatatggcaagattgtttccactaaggccatactggacaagaccacaaacaaatgtaaaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctccctcagcagcacaggcacgtatatgccgacggctgcagctatgcaaggagcttacatctcccagtacacccctgtgccttcttccagtgtttcagtcgaggagagcagcggccaacagaaccaagtggcagtggacgcaccctcagagcatggggtctattctttccagttcaacaagtaacagtgggattcccctccccatctttactgaatagaaatgaattcttggagatactcatgctcccagattccagagggttaaccaggaatggagaccatccgtcggcccacaacccacgcgcccacgcgcccaccaa

SEQ ID NO: 1833 - DNA, 1621 bp, Homo sapiens
ctccttttctcctcctttctcctccccctcccttttttcctccctccctctccccctttccctcgctcccctcctccctccctccccgtctttcttaccccctccctttctctctctctctctctctcactcgttccctaacattaaagagaaaatgctgctatccgtgacttccaggcccgggatttcgacttttggctacaatagaaacaacaagaagccatatgtgtcactggctcagcagatggcaccacctagcccaagcaacagtacacctaacagcagtagtggaagcaatggaaatgaccagctgagcaaaaccaacctatacatccgaggattgcaaccaggcactactgaccaagatcttgtcaagctgtgtcagccatatggcaagattgtttccactaaggccatactggacaagaccacaaacaaatgtaaaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggttttacccagccccctataacatcacccccaacaggatgcttgctcagtctgcactctccccatacctttcctctcctgtgtcttcgtatcagagagtgactcagacatctcctctacaagtacctaacccatcctggatgcaccaccattcatacctcatgcagccttcaggttcagttctgacaccagggatggaccatcccatttctctccagcctgcctccatgatgggaccccttacccagcaactgggccatctctccctcagcagcacaggcacgtatatgccgacggctgcagctatgcaaggagcttacatctcccagtacacccctgtgccttcttccagtgtttcagtcgaggtaagggtgttatcatttctttggattgagattaggaaaatgaacggaggcaggtttccccctgatcaagatctttctctcacaatgatgctgattctgtgttcacaaatagctggtaggtatacgaagaatgtaggaaggatgtgctcgcttcggcagcatgcatactaaaattggaacaatacagagaagattatggcccctgtgcaaggatgacatgcaaatttgtgaagcgttccatatttaaaaaaaaaacaacagcagatgtaggaaagaaggacttggtctgagttcatgaatgaggcccttccttacatttggcca

SEQ ID NO: 1834 - DNA, 2019 bp, Homo sapiens
ggggttttgagcagttctagatagagctggaagagtggaaggaagagaaagggctataagttggggtggtgagggtcttcttccagcaggtggctggtggtctgctctggagaggctgcattccctacatgcctagcatttctggggtatatcaagaaaagaggggagtgaattcttttagaggtataggggggctttgggttattagcagagcctagttcctgaaacctcaaatttcttaagggggagggagaagggcagggacaccagagtagctcattgccttggcattcttagccacaaagtagatcacatctcagggtttgaggagcatgtggataactacctgaaacctctcaatagctctttctccctcccatttctgttacatggatcataactcttcctctgtctcctgaaaagcctggacctctctgttccttacacctcccacttcctagtgatgctgtttcctctgttccaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaagattctcgccctgttgcccaggctggagtgcaatggcgtgatctcgactcactacaacctctgcctcccaggttcaagcgattctctcacctctgcctcctgagtagctgggactacaggatggagtccacagagaagtgtgaagccatcatcacccactttaatggaaaatatattaagacaccccctggagtaccagccccatccgatcccttgctttgcaaatttgctgatggcgggccaaagaaacgacagaaccaaggaaaatttgtgcaaaatggacgggcttggccaaggaatgcagacatgggcgtcatggccttgacctatgaccccaccacagctcttcagaatgggtaaggttttatataatcaagccacctgaaaatgataatggcctgtgtccagacactcaaatgattcatcttgattctctctatttgaaagtcaagggaacgttggctgtgcctatcagttgggacccttcccttgtggtttcctgtgactcagtactgattgaggttccttcccacaggttttacccagccccctataacatcacccccaacaggatgcttgctcagtctgcactctccccatacctttcctctcctgtgtcttcgtatcaggtatgttcatgcctgaaaaatggtgtggtggttttccctactactgtgctttaagtgaagtaatataaggctaggaactacttgttttttgtttttccttttaatcatattacacacaattttacataacagcgtaaaagatgatctgtgcatgtggtcatatatatggtatacagttttaatggtgtcctcttactccccctccaccacctccacaagtaaactcatgttaatgtcctactgtgtagcatttgtcatattttttcatatgaatacacatatgtatagcatttggggagttgtttattttacaaaaattggaccagattaaatatatttttacattcactcatctcacttaacagtatcctacaccagtgaaacctagtctttactaaaaacacagaaattagctgggcatggtggcgggcgcctgtaatcccagctacttgggaggctgaggccagagaattgcttgaacccagcaggcagaggttgtggtgagccgagatcgcgccactacactccagcctgggcgacaagagtgaaactctgtctcaaaaaaaaaacaaaaaaattgttcctgtcttgatgaatgtaaagtacatcgttattttaatttgcatgtcccttactataggtgaatttaaccatttc

SEQ ID NO: 1835 - DNA, 770 bp, Homo sapiens
ggggttttgagcagttctagatagagctggaagagtggaaggaagagaaagggctataagttggggtggtgagggtcttcttccagcaggtggctggtggtctgctctggagaggctgcattccctacatgcctagcatttctggggtatatcaagaaaagaggggagtgaattcttttagaggtataggggggctttgggttattagcagagcctagttcctgaaacctcaaatttcttaagggggagggagaagggcagggacaccagagtagctcattgccttggcattcttagccacaaagtagatcacatctcagggtttgaggagcatgtggataactacctgaaacctctcaatagctctttctccctcccatttctgttacatggatcataactcttcctctgtctcctgaaaagcctggacctctctgttccttacacctcccacttcctagtgatgctgtttcctctgttccaggctatggctttgtagattttgacagcccttcagcagcacagaaagctgtaacagcactgaaggccagcggtgtacaggcacagatggcaaagcaacaggaacaggaccccacaaatttatacatctcaaacctcccactgtcaatggatgagcaggaactggaggggatgctgaagccctttggccaggttatctccacccgtatccttcgagataccagtgggaccagcagaggtgttggctttgcaagactccagcctgggcgacaagagcaaaactccatctc

SEQ ID NO: 1836 - DNA, 363 bp, Homo sapiens
  misc_feature (15)..(15): n is a, c, g, or t
  misc_feature (19)..(19): n is a, c, g, or t
  misc_feature (25)..(25): n is a, c, g, or t
ctcgtgcacattcgngcancgcggncacgagattgactctataaatagtgtgacccatttttaactagattgctgatatgtttttcagcaggactttgtggtttagttaatgaaatcttttcagggatgatcctctgagccttctgtctagttactatcactgctgttgcttttatgacttaattgcctttgtggtttaattcacttcatgacacatctatcaccatgaagtttagactcttcacccctatctttccgagtatttgcttgatgactcctggggtcaaggagaggttgataggtggttttatgctgttaaaaataagtggtcttggctaacttatcacttagttaaaacagtcc

SEQ ID NO: 1837 - DNA, 467 bp, Homo sapiens
aaattttctgtcaagtttgggcagaatttaaagactatttcctttggtgggcatgaagtagtactgtttaacatgcttgctcaataaagttttcagactttttttttttttaactagagaatatgtgatttggtgattgactctataaatagtgtgacccatttttaactagattgctgatatgtttttcagcaggactttgtggtttagttaatgaaatcttttcagggatgatcctctgagccttctgtctagttactatcactgctgttgcttttatgacttaattgcctttgtggtttaattcacttcatgacacatctatcaccatgaagtttagactcttcacccctatctttccgagtatttgcttgatgactcctggggtcaaggagaggttgataggtggttttatgctgttaaaaataagtggtcttggctaacttatcacttagttaaaacagtcc

SEQ ID NO: 1838 - DNA, 476 bp, Homo sapiens
ttcatttttgggagcctctcttaaaatgcaaataacctttaagaagggttactgttgatgccttggtgggaattaatttttagattctttcttgaaattttactggataagtagggcacagagactgcccttcccttacctccttctctctctctctccttctctttccttccttccttcctttcccttttcctttccctttcgctttcctttcctgtctcactctgttacccaggctggagtgcagtggctctatcttggctcactacaatctctgcctccggggttcaagcaattctcctgcctcagcctccagagtagctgggactacaggcgtggtggcgctggcctgtaatcccaactactcagaggctgagacaggaggattgcttgaactcaagaggcggaggttgcagtgagctgagatcgcgccactgcactccaacctaggcaacagagacaaattcgtctcagag

SEQ ID NO: 1839 - DNA, 355 bp, Homo sapiens
atttctgacacccgtgggaatgaggccctttttattcatagctgcatcccctgtgtctaagagggcatacttaatacatagcagagattcaataaatgttcgctgagggagtggatgaatgagtggggctgatgattgagaactcccagtatatcctacatatggacttgtgttttctccattccttcctccccaaaatatctggggcagcatgtgagagtctcttcattttctattggaaattggagtacttgaatccagaagtttaaatctatgaaggtgaaatgcggttaggctaagtggatggacccttagttagatcctctctgggtgatttgtttccccagtggtactt

SEQ ID NO: 1840 - DNA, 407 bp, Homo sapiens
gcttcattctgtcctttctcctcctttttcttatgggccatcacataaaagagaaccttttttaaatgatagaaatatttttattttaaaaggacaatttgcaactttctagaacatcagtagcttgaactgtataccaattcaaaaccaaaagcatctgtatggcactgtgaaaaaaaactaacaaactggagaaaatgttactatctatgttagtcaataagacttagagcttttatgagtcaataagaaaaatagatgaacaagccctatagaaaaatgagcagaggctgggtgtgatggctcaggcctgtagtcccagcactttgggaggccaaggagggaggatcacttgagcctaggagtttgagaccagtctgggcaacatagtgagaccctcatctctc

SEQ ID NO: 1841 - DNA, 402 bp, Homo sapiens
aggaaaataatgtgaccaaataatttatcatccatccaagaacatttttgagtactcttaaaaattacaccagaaccacaggaataaaccacagctgctctggaagggtcctgggcaagctggacctaagagcaccccagaaatgaaagtctttgtttctttttaaaaaattgttgacatcactgaacaggtgaaaagggctctctgattctttccaaaggggagagtaatgagaaaggatgaaaaggagcagagatgtatcagttaagatgctttcaattgcacataactgagtagccagagataatgggcttaaattaaagggatttctttgtctcacataacagtggtccagtgacaggtggatcaatggctcaaccatagcaggtgtattagtccatt

SEQ ID NO: 1842 - DNA, 433 bp, Homo sapiens
aaagaggggttcagctaaatgcaagcttcagctagaaacatacactgttctggaagggatttagctaaccacattttactgttggaggcatttctaggtttggaaatgatttgtccaaggtcatttggtcagtcagtgtgtggtttatggccccattctcctgacttcggtgtttattcccctacagcacaaatcttgctgctttcccccacattagatgtttgccagctgggccatgttggtggggttaggggccattgagattcattgagaagaaaggagaaggaaaagctgaccatcagcatctacgagtccctggcctggccctttagttgggaacaattattgttacccagtgtgtagaacaaagagcgtaatcttggaacaaatagacatcagtgtcttctacctctttccttctaattaaaaaaaa

SEQ ID NO: 1843 - DNA, 734 bp, Homo sapiens
gtagagacagggtttctccatgctggtcaggcttgtctcgaacttccaacctcaggtgatcctcccgccttggcctcccaaagtgctgggattacaggcgtgagccaccacactggaccctattttgccctttttaagtactggcttaacgagtgaaaaagatgcatgtgcactgaaaaaagactaggaaaagatagaatacaatgccagtagagattgtctctatgagacagcataggctattgttattttagacgtaaatttctctacttttcaaaattaccacctatttggataccttttcttagttttataaaatatggccattggggaaaacttgaaaattgagcaaaatacagagaagagaattttaaaatgacccatgattccaccactcagataactacagatggcattttggtgcattgcacttgtcacttgtagtcagaacagcaaatgtgcttcattttccaggcctgcaatttgttccttttgcacacatttctgacaacctgccctggactgcgttctcatagaatggctgtcctccccactgtgggagcccttgctgagcctaacaaataaagcctccttcacaatagagctaaagaggagcttcatcagagaaacactgccgccttagtagatactggcccaggttggtcttgagtcccaaacttgtacagtgggttctcaaagtgtaacttaaacattatgttggcatcatgttaagc

SEQ ID NO: 1844 - DNA, 537 bp, Homo sapiens
gttttttgttttcttttcccttagccagaacatgtgggctaacagggtgtgttttctttcaggaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacaggtacctctccggcaggcagccctctgcccaccgccccagcatgtgggcggggctgggcccaaggtggggggatgtgtgggaacagaagtcagatgttggagccgccacgcctctcccagttctttggtccctggtggtgtcctaccacatactgctcacttgccatgtggcgggcctggtgaagaaaggcaggttctaggaaccgtcaagttttctccttccctaaacttcatcactcaaattttcttagttatcagactggcaaagaaggagaaggaaagattccagttacaaagggttgaagaaattgggtggttgtgag

SEQ ID NO: 1845 - DNA, 227 bp, Homo sapiens
tcagctgattttctttattcttatgcttttttaaaaggcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtaagctcaatccttcaggtgggtggcaaggaacagccccg

SEQ ID NO: 1846 - DNA, 6239 bp, Homo sapiens
gagaagaagtggcaggtgatgctgaagcgggggagaagcggcagagccggccacacagtgcaggggatggagacaggtgctgggctggtcctcctgcagcatcctcagttgttggagggcagtcatcctcaggccgtacccagccagagaagaaaaagaacagtgtgaagccacgtgtgatagccgtccaacatcggctcttccctccaattacattgtagttgattgtgtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagaccacctatccccagacagcgtgtcctaagagtgattcagagctggaggtgaaacctgcggagagcctgctcagatcagagtctcacatggagtggacgtggggcggattcccagagtccaccaaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtgttcacaaaagaagccaacaccagggacctgatgatatttaccttgatgacttaaagggtctagaacctgaagttgcagctctttatttccctaaaagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaagaaaaattcatggagcatatcattacttatcacgaatttgcagaaaaccctggacttatagacaatcctaaccttgtaataaggatatataatcgttactataactgggctttggcagctcccatgatccttagcttgcaagtattccagaagagcttgcctaaggccacagttgagtcctgggtgaaagacaagatgccaaagaaatctggtcgctggtggttttggcgaaagagagaaagcatgaccaaacagctgccagaatccaaggagggaaaatctgaggcaccgccagccagtgacctgccatccagctccaaggagccggccggtgccaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtcggatgctttgggacagattctcccacagctgggcaaagactggacccaccagggtatagcaaagctctaccattccatcaatgagaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacagagaagtgatagaaaagaaaccagagaagttcaaaattgagtgtctaaatgatatcaagaatctgtttgccccgtctaagcagcccttctatgctgcctttggaaaccgtccaaatgatgtctatgcctacacacaagttggagttccagactgtagaatattcaccgtgaaccccaagggtgaattaatacaagaaagaaccaaaggaaacaagtcatcgtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaattttgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaaaaaaaaaaac

SEQ ID NO: 1847 - DNA, 418 bp, Homo sapiens
actgtgtctgcaagcagtttgtactcagtttgtcaagagagcagctttctgttttgattatataccttcatctctgaaaaaagacatgctagttaaatttcaagatgttttacttagaagatgacaaggaagatgaggtggtttgtaaaggctcattaagtaaaactcaagatgtttaccatgacaagtcccctcctggtatcttggtctcactgccacccagtctggagtgcagtgtaggaggcaacctctgcctcccaggctcaagcagtcctttcgcctcagccttctaaggagctaggacctcagttacgggcacccttgcccctgcctcggctgactttcacactggacttcctctggatggaccagcagtcttttgccgcggagtttgctgctgcgctgctcagtattctcc

SEQ ID NO: 1848 - DNA, 514 bp, Homo sapiens
atggaggagatggtgagggtgcataacaaatgtcaaaaatcacttttggaaagattagttatttggtttcaattctgatatgaaaacaagccccttgacattggggcggaggaaaagagaaagtgtggcagtcagttacctccgaacacacacatctggcgctcgtgagactccgctttcagaagcacctcagtgggtgcgtttgcatgggatggccttgcagttgcttgaagctgtgattaaatcccctttcaagagtgtcccgccaccaattagttattggcagctgatagtcaaccaaataggaaaacgctgtatgtgtttgattcctgatagcttttcctgtttctaccgtcttcttaggtcggatgctttgggacagattctcccacagctgggcaaagactggacccaccagggtatagcaaagctctaccattccatcaatgagtaggtaccctccccacgttaactcgctctggtgagctggaagcttgctttaagaactatagaa

SEQ ID NO: 1849 - DNA, 6067 bp, Homo sapiens
gcagtccagccgccgcctgccctcagccgcccgctggccgggagcggagcccctgtggtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagaccacctatccccagacagcgtgtcctaagagtgattcagagctggaggtgaaacctgcggagagcctgctcagatcagagtctcacatggagtggacgtggggcggattcccagagtccaccaaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtgttcacaaaagaagccaacaccagggacctgatgatatttaccttgatgacttaaagggtctagaacctgaagttgcagctctttatttccctaaaagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaagaaaaattcatggagcatatcattacttatcacgaatttgcagaaaaccctggacttatagacaatcctaaccttgtaataaggatatataatcgttactataactgggctttggcagctcccatgatccttagcttgcaagtattccagaagagcttgcctaaggccacagttgagtcctgggtgaaagacaagatgccaaagaaatctggtcgctggtggttttggcgaaagagagaaagcatgaccaaacagctgccagaatccaaggagggaaaatctgaggcaccgccagccagtgacctgccatccagctccaaggagccggccggtgccaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtcggatgctttgggacagattctcccacagctgggcaaagactggacccaccagggtatagcaaagctctaccattccatcaatgagaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacagagaagtgatagaaaagaaaccagagaagttcaaaattgagtgtctaaatgatatcaagaatctgtttgccccgtctaagcagcccttctatgctgcctttggaaaccgtccaaatgatgtctatgcctacacacaagttggagttccagactgtagaatattcaccgtgaaccccaagggtgaattaatacaagaaagaaccaaaggaaacaagtcatcgtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaattttgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaaaaaaaaaaac

SEQ ID NO: 1850 - DNA, 6215 bp, Homo sapiens
actgtgtctgcaagcagtttgtactcagtttgtcaagagagcagctttctgttttgattatataccttcatctctgaaaaaagacatgctagttaaatttcaagatgttttacttagaagatgacaaggaagatgaggtggtttgtaaaggctcattaagtaaaactcaagatgtttaccatgacaagtcccctcctggtatcttgtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagaccacctatccccagacagcgtgtcctaagagtgattcagagctggaggtgaaacctgcggagagcctgctcagatcagagtctcacatggagtggacgtggggcggattcccagagtccaccaaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtgttcacaaaagaagccaacaccagggacctgatgatatttaccttgatgacttaaagggtctagaacctgaagttgcagctctttatttccctaaaagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaagaaaaattcatggagcatatcattacttatcacgaatttgcagaaaaccctggacttatagacaatcctaaccttgtaataaggatatataatcgttactataactgggctttggcagctcccatgatccttagcttgcaagtattccagaagagcttgcctaaggccacagttgagtcctgggtgaaagacaagatgccaaagaaatctggtcgctggtggttttggcgaaagagagaaagcatgaccaaacagctgccagaatccaaggagggaaaatctgaggcaccgccagccagtgacctgccatccagctccaaggagccggccggtgccaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtcggatgctttgggacagattctcccacagctgggcaaagactggacccaccagggtatagcaaagctctaccattccatcaatgagaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacagagaagtgatagaaaagaaaccagagaagttcaaaattgagtgtctaaatgatatcaagaatctgtttgccccgtctaagcagcccttctatgctgcctttggaaaccgtccaaatgatgtctatgcctacacacaagttggagttccagactgtagaatattcaccgtgaaccccaagggtgaattaatacaagaaagaaccaaaggaaacaagtcatcgtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaattttgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaaaaaaaaaaac

SEQ ID NO: 1851 - DNA, 5342 bp, Homo sapiens
ttttagtttttctcactttattatggaatttttacatgtacaaactaagatatttaatgaatgtgttaagttaaaaatagaatgaacacattgccagcttaggaaatagattataacaaatactctgaaagtagtttaatttttaaacaatttaacttttttaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtgttcacaaaagaagccaacaccagggacctgatgatatttaccttgatgacttaaagggtctagaacctgaagttgcagctctttatttccctaaaagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaagaaaaattcatggagcatatcattacttatcacgaatttgcagaaaaccctggacttatagacaatcctaaccttgtaataaggatatataatcgttactataactgggctttggcagctcccatgatccttagcttgcaagtattccagaagagcttgcctaaggccacagttgagtcctgggtgaaagacaagatgccaaagaaatctggtcgctggtggttttggcgaaagagagaaagcatgaccaaacagctgccagaatccaaggagggaaaatctgaggcaccgccagccagtgacctgccatccagctccaaggagccggccggtgccaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtcggatgctttgggacagattctcccacagctgggcaaagactggacccaccagggtatagcaaagctctaccattccatcaatgagaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacagagaagtgatagaaaagaaaccagagaagttcaaaattgagtgtctaaatgatatcaagaatctgtttgccccgtctaagcagcccttctatgctgcctttggaaaccgtccaaatgatgtctatgcctacacacaagttggagttccagactgtagaatattcaccgtgaaccccaagggtgaattaatacaagaaagaaccaaaggaaacaagtcatcgtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaattttgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaaaaaaaaaaac

SEQ ID NO: 1852 - DNA, 6014 bp, Homo sapiens
gcagtccagccgccgcctgccctcagccgcccgctggccgggagcggagcccctgtggtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagaccacctatccccagacagcgtgtcctaagagtgattcagagctggaggtgaaacctgcggagagcctgctcagatcagagtctcacatggagtggacgtggggcggattcccagagtccaccaaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtgttcacaaaagaagccaacaccagggacctgatgatatttaccttgatgacttaaagggtctagaacctgaagttgcagctctttatttccctaaaagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaagaaaaattcatggagcatatcattacttatcacgaatttgcagaaaaccctggacttatagacaatcctaaccttgtaataaggatatataatcgttactataactgggctttggcagctcccatgatccttagcttgcaagtattccagaagagcttgcctaaggccacagttgagtcctgggtgaaagacaagatgccaaagaaatctggtcgctggtggttttggcgaaagagagaaagcatgaccaaacagctgccagaatccaaggagggaaaatctgaggcaccgccagccagtgacctgccatccagctccaaggagccggccggtgccaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtcggatgctttgggacagattctcccacagctgggcaaagactggacccaccagggtatagcaaagctctaccattccatcaatgagaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacagagaagtgatagaaaagaaaccagagaagttcaaaattgagtgtctaaatgatatcaagaatctgtttgccccgtctaagcagcccttctatgctgcctttggaaaccgtccaaatgatgtctatgcctacacacaagttggagttccagactgtagaatattcaccgtgaaccccaagggtgaattaatacaagaaagaaccaaaggaaacaagtcatcgtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcacgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaattttgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaaaaaaaaaaac

SEQ ID NO: 1853 - DNA, 4276 bp, Homo sapiens
atggaggagatggtgagggtgcataacaaatgtcaaaaatcacttttggaaagattagttatttggtttcaattctgatatgaaaacaagccccttgacattggggcggaggaaaagagaaagtgtggcagtcagttacctccgaacacacacatctggcgctcgtgagactccgctttcagaagcacctcagtgggtgcgtttgcatgggatggccttgcagttgcttgaagctgtgattaaatcccctttcaagagtgtcccgccaccaattagttattggcagctgatagtcaaccaaataggaaaacgctgtatgtgtttgattcctgatagcttttcctgtttctaccgtcttcttaggtcggatgctttgggacagattctcccacagctgggcaaagactggacccaccagggtatagcaaagctctaccattccatcaatgagaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacagagaagtgatagaaaagaaaccagagaagttcaaaattgagtgtctaaatgatatcaagaatctgtttgccccgtctaagcagcccttctatgctgcctttggaaaccgtccaaatgatgtctatgcctacacacaagttggagttccagactgtagaatattcaccgtgaaccccaagggtgaattaatacaagaaagaaccaaaggaaacaagtcatcgtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaattttgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaaaaaaaaaaac

SEQ ID NO: 1854 - DNA, 3888 bp, Homo sapiens
gttttttgttttcttttcccttagccagaacatgtgggctaacagggtgtgttttctttcaggaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacagagaagtgatagaaaagaaaccagagaagttcaaaattgagtgtctaaatgatatcaagaatctgtttgccccgtctaagcagcccttctatgctgcctttggaaaccgtccaaatgatgtctatgcctacacacaagttggagttccagactgtagaatattcaccgtgaaccccaagggtgaattaatacaagaaagaaccaaaggaaacaagtcatcgtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaattttgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaaaaaaaaaaac

SEQ ID NO: 1855 - DNA, 6014 bp, Homo sapiens
gcagtccagccgccgcctgccctcagccgcccgctggccgggagcggagcccctgtggtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagaccacctatccccagacagcgtgtcctaagagtgattcagagctggaggtgaaacctgcggagagcctgctcagatcagagtctcacatggagtggacgtggggcggattcccagagtccaccaaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtgttcacaaaagaagccaacaccagggacctgatgatatttaccttgatgacttaaagggtctagaacctgaagttgcagctctttatttccctaaaagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaagaaaaattcatggagcatatcattacttatcacgaatttgcagaaaaccctggacttatagacaatcctaaccttgtaataaggatatataatcgttactataactgggctttggcagctcccatgatccttagcttgcaagtattccagaagagcttgcctaaggccacagttgagtcctgggtgaaagacaagatgccaaagaaatctggtcgctggtggttttggcgaaagagagaaagcatgaccaaacagctgccagaatccaaggagggaaaatctgaggcaccgccagccagtgacctgccatccagctccaaggagccggccggtgccaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtcggatgctttgggacagattctcccacagctgggcaaagactggacccaccagggtatagcaaagctctaccattccatcaatgagaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacagagaagtgatagaaaagaaaccagagaagttcaaaattgagtgtctaaatgatatcaagaatctgtttgccccgtctaagcagcccttctatgctgcctttggaaaccgtccaaatgatgtctatgcctacacacaagttggagttccagactgtagaatattcaccgtgaaccccaagggtgaattaatacaagaaagaaccaaaggaaacaagtcatcgtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccccatggggacacgggtgcctatgtattttcactaaaatatacatggtagctccatttactgatgcggttgtaatgagctcacatcgtgtctgaagagatggcaccagggaaaggtgtgccataagctgctccagagcttttggtatgctgagtgttgacagagctgcactcttaacatcaagagaactgtcaggagcccagaaccaaccccaggtcttggtctccattggcgagaacacaggacgtggtggttcctgagcagagagggatctgcagatacaggcttggcgctcggggtggtctcgtggccaactcttcatgcccctgccgttgtagtggaacctctacatgttttagtttgcttcacctaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgcatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaattttgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaaaaaaaaaaac

SEQ ID NO: 1856 - DNA, 1875 bp, Homo sapiens
ggtgactagagttcccgactagtccaacatatagtccctacatacactaaaataatgctgatctagagatagagaaataggggtggttatttttccagattggagagttgaaagtccctgactgatttcagccattttcctagtgcttgtcggatgcagagacaatgttgaaatcccctaaacacagttctcagtggcaaaacctaggaaggctcatgttcccagagaagggaccacatgagccttctcccatgcaaagcttcccccagcttaaatagttgataaggactaattgtttaatgagtttatttatctacagtaggttagggatcctgggttctgtttatatgaagttcttcccagtttgtgaattctagtacagcagccatgcagccaccttatttcatagatgccatctgtgtgtcctcttgactaccttctatttagaggaagaatgagagctttgtgtgtttaactgagcttatagtaggacttctttgcatatgtatggtactgaaaaatcttaatatacatctttaatcctttttaggttgtcctttaaagagtttttgactagtttctttttcttgacagctcttctctttggacacatgggccttcttagagggttcagtctaggacccggctctcctggccctgtgttgagggtagctggtccctctgtccctgtgtctgctagcactagactttgttgctgcagattgatccagtgggtacataggctaattaatgtgagtctttttccttgtttaaaggagtccctcttgctgaaagtagatgattactattgctgtagtgttaggaaagtattaagtttgtgctgaaaatccattgccatttggtacaaatgacatttgttctttctgtgaaagagatgccctcgagtgtgtttgtacacaaacccttaggatggtgagttgaagcatcaccctcgcgctatcttcagtgacgggtgacggctcagggagatggcaggcagattgggctctaagtcattattctctcagttactccattggtgaaatggccctttccctctttgcagttcagtctaagtctcgtatttgctttgctgtctgtgtgctgaagctcgtcccgtgtgagttgctgtctgccccttgtcaggctgtgaggtgctcgtgtagacctggagcatgcaggctgcctccgtttttgggtactgtgttgtgttttgctctgtctaaaaacatctgcatagttttcaactggaaaaagaaaaaacttaaaaatgggatgtcctaaaatgaaagctgctcaaagtcacagaacaaccgagggacaaaggagattggatgactgggaagcgctggcccggaacagcccctgcaactgtggggcctgcacacagcccttccacagttggcactgcaggtgcaggccaaccctttaaagaataaacaaggaagtcagctctttcactttttacaagttggcaaaaacagacttccggggaattttgatgttttcccgtgttgtagagcttccagggtttaataaaactggttaaaaattgagtctttccctgaagtaagtgctctttccagatgaaaactactcttttggttttgtttgaaagtaagaaagggaggggaaactttgctcttttaataattatgttcagcctatgatgaagtatttgattattagacagcaatgtcactaataagttttaagttgtccaaagttaattgtaaacatcatcagtacagtactcttagttacagtaaagcaattgttgcaagatgaatggctaatattttggtgcagtgtttgatgttcaaaacaaaatgttacaacaataaacgaacataacataaactgaaaaaaaaaaac

SEQ ID NO: 1857 - DNA, 3958 bp, Homo sapiens
gcagtccagccgccgcctgccctcagccgcccgctggccgggagcggagcccctgtggtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagaccacctatccccagacagcgtgtcctaagagtgattcagagctggaggtgaaacctgcggagagcctgctcagatcagagtctcacatggagtggacgtggggcggattcccagagtccaccaaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtgttcacaaaagaagccaacaccagggacctgatgatatttaccttgatgacttaaagggtctagaacctgaagttgcagctctttatttccctaaaagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaagaaaaattcatggagcatatcattacttatcacgaatttgcagaaaaccctggacttatagacaatcctaaccttgtaataaggatatataatcgttactataactgggctttggcagctcccatgatccttagcttgcaagtattccagaagagcttgcctaaggccacagttgagtcctgggtgaaagacaagatgccaaagaaatctggtcgctggtggttttggcgaaagagagaaagcatgaccaaacagctgccagaatccaaggagggaaaatctgaggcaccgccagccagtgacctgccatccagctccaaggagccggccggtgccaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtcggatgctttgggacagattctcccacagctgggcaaagactggacccaccagggtatagcaaagctctaccattccatcaatgagaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacagagaagtgatagaaaagaaaccagagaagttcaaaattgagtgtctaaatgatatcaagaatctgtttgccccgtctaagcagcccttctatgctgcctttggaaaccgtccaaatgatgtctatgcctacacacaagttggagttccagactgtagaatattcaccgtgaaccccaagggtgaattaatacaagaaagaaccaaaggaaacaagtcatcgtatcacaggctgagtgagctcgtggagcatgtgttcccccttctcagtaaggagcagaattccgcttttccctgcccggagttcagctccttctgctactggcgagacccgatccctgaagtggacctggatgacctgtcttgaggcggcacctcagtgggtgggcagggcttggtccccctccccacagcaagggaaggcagctggctcttctgctgacctcagataccagccttccccagcggggacgggtgcttctggagctggtcccgccatcctcctttgccttcccaggccagctgctcaggctcggcaggtctgcagctcagctcctggaaggagaagggaggaactgggcctggggctggaggcctgggatccctcctttgtgggtcgcacacatgtttcctgctgtgagctggggcctccttccattgcatcattttaaaggaagaaaaaagcagctaaaaaagagtggaccaaaacactgcacacagtgaagtgttccagtttccactgggcagttgaggtggcttctgtaaccagggctgtcttcagatgtcagggtccctgaactgctgcgggcccagtcagtgatgctggctgaagctgcctgtgcacgtttcttctctggtcgcctcatttcctgctacactgaaggggtcagctgctccagtgggccaagttgggcaggacccccgcccctgcagggcccatgcaccagagccactgagcccagtcccataaacctggccctctttggggaaagatccccacagagcatcctcctctcatctgtgacaactccacgagcccttaatttcttagtcctcaccagaagaacaggtctcacaagtatatatttgatgtctgtaataaaagtgggaaggtgggtcttaaaacagaccaaaccccgccccgcccccaacaactctgcttttagggaggcctccgaaatgcagataggcggttgagtggggtcctgggaagagcgctgaatccctctgcttgctgcctggtgtgggcctttggaaagcatcttgccttgggacaggatttctaaaattctgtgattcagatttgtcagggaagcacagtgaagcttgcttaaaggcactggccagcagtgtgtgactttggcttttgggatcacaccctgtaatcgggcccgtggaagcagcgtcaaagaggggtcttggagctcctatggagcagactgccccccgagcagtgtccccagcctagccctgtgagaccatgggaccggtgctatgttttccttaatttctggagtccttatgttgggtgtatggtcctcgttgaagatggccgggaggtgccaag

SEQ ID NO: 1858 - DNA, 2716 bp, Homo sapiens
gcagtccagccgccgcctgccctcagccgcccgctggccgggagcggagcccctgtggtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagaccacctatccccagacagcgtgtcctaagagtgattcagagctggaggtgaaacctgcggagagcctgctcagatcagagtctcacatggagtggacgtggggcggattcccagagtccaccaaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaaggtgttcacaaaagaagccaacaccagggacctgatgatatttaccttgatgacttaaagggtctagaacctgaagttgcagctctttatttccctaaaagtgaatcggagcccggttccaggcagtggcccgagtctgacacactctctggctcccagtccccacagtccgtgggaagcgcagctgcagatagcggcaccgagtgcctctcagattctgccatggacttgcctgacgttaccctctccctttgcgggggcctcagtgaaaatggagaaatttcaaaagaaaaattcatggagcatatcattacttatcacgaatttgcagaaaaccctggacttatagacaatcctaaccttgtaataaggatatataatcgttactataactgggctttggcagctcccatgatccttagcttgcaagtattccagaagagcttgcctaaggccacagttgagtcctgggtgaaagacaagatgccaaagaaatctggtcgctggtggttttggcgaaagagagaaagcatgaccaaacagctgccagaatccaaggagggaaaatctgaggcaccgccagccagtgacctgccatccagctccaaggagccggccggtgccaggccggccgagaatgactcctcgagtgacgagggatcacaggagctcgaagaatccatcacagtggaccccatccccacagagcccctgagccacggcagcacaacttcatataagaagtctctccgcctctcctcagaccagatcgcaaaactgaagctccacgatggcccaaatgatgttgtgtttagtattacaacccagtatcaaggcacctgtcgctgtgcagggaccatttacctgtggaactggaatgacaagatcatcatttctgatattgatgggacaataaccaagtcggatgctttgggacagattctcccacagctgggcaaagactggacccaccagggtatagcaaagctctaccattccatcaatgagaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacaggtacctctccggcaggcagccctctgcccaccgccccagcatgtgggcggggctgggcccaaggtggggggatgtgtgggaacagaagtcagatgttggagccgccacgcctctcccagttctttggtccctggtggtgtcctaccacatactgctcacttgccatgtggcgggcctggtgaagaaaggcaggttctaggaaccgtcaagttttctccttccctaaacttcatcactcaaattttcttagttatcagactggcaaagaaggagaaggaaagattccagttacaaagggttgaagaaattgggtggttgtgag

SEQ ID NO: 1859 - DNA, 1282 bp, Homo sapiens
  misc_feature (1236)..(1236): n is a, c, g, or t
  misc_feature (1261)..(1261): n is a, c, g, or t
  misc_feature (1280)..(1280): n is a, c, g, or t
gcagtccagccgccgcctgccctcagccgcccgctggccgggagcggagcccctgtggtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtgattgatatagaaatcaacggcagtgcagtggatcttcacatgaagttgggtgataacggagaagctttctttgttgaggagactgaagaagaatatgaaaagcttcctgcttaccttgccacctcaccaattcctactgaagatcagttctttaaagatattgacacccctttggtgaaatcgggtggagatgaaacaccatctcagagttcagacatctcacacgtcttggaaacagagacaatttttactccaagttctgtgaaaaagaaaaaacgaaggagaaagaaatacaaacaggacagtaagaaggaagagcaggccgcatctgctgctgcagaagacacatgtgatgtaggcgtgagctccgatgatgacaagggggcccaggcagcacgaggatcttcaaatgcttccttgaaagaagaagaatgtaaagagcctttgctcttccattctggggatcattaccccttatctgatggagattggtcccctttagagaccacctatccccagacagcgtgtcctaagagtgattcagagctggaggtgaaacctgcggagagcctgctcagatcagagtctcacatggagtggacgtggggcggattcccagagtccaccaaggtcagcaaaagagaacgatctgaccatcatcctaggacagctacaattacaccatcagaaaatactcattttcgggtaattcccagtgaggacaacctcatcagtgaagttgagaaggatgcttccatggaagacactgtctgtaccatagtgaagcccaaacccagagccctgggtacacagatgagcgacccaacatctgtggcagagcttctcgaacctcctcttgagagtactcagatttcatctatgttagatgctgaccaccttcccaacgcagccttagcggaggcgccctcagaatccaaaccggcagctaaagtagactcgccgtcaaagaagaaagngtcacaaagaaccacacaggactgngaattacctgtgctaaggnta

SEQ ID NO: 1860 - DNA, 844 bp, Homo sapiens
actgtgtctgcaagcagtttgtactcagtttgtcaagagagcagctttctgttttgattatataccttcatctctgaaaaaagacatgctagttaaatttcaagatgttttacttagaagatgacaaggaagatgaggtggtttgtaaaggctcattaagtaaaactcaagatgtttaccatgacaagtcccctcctggtatcttgtctcaaaccatgaattatgtgggacagctggctgggcaggtgattgtcactgtgaaggaactctacaagggcattaaccaggccaccctctctgggtgcattgatgtcatcgtggtacagcagcaggatggcagctatcagtgttcaccttttcacgttcggtttggaaagctgggagtcctgagatccaaagagaaagtggtgagtgtcctcaaggagaggaaaagtcatccctgagattcaaagagaaagtgagtgagtgtcctcaaggagtagaaaagtcatccctctatgaataaatcgctattgtgagttttctaggcctttttttttttttaacctgaatgatgttgagacaatgttacgagaagtcaacctttatgtattgcttttgaagttactttgaaaaccacaaagctcgactgcagaagtctcttcaagggaaagggaaactgaaaattattataataatcttacatgttgcaactcagaaaagcaaaacagaaactagatgggggaacttagacatatttagaaaaagaaaaatttcctttaccttatatagtatttttaaatacttaggctaataccttcatactaattgtaaatggaataggtgggtataatcaagaacacac

SEQ ID NO: 1861 - DNA, 814 bp, Homo sapiens
actgtgtctgcaagcagtttgtactcagtttgtcaagagagcagctttctgttttgattatataccttcatctctgaaaaaagacatgctagttaaatttcaagatgttttacttagaagatgacaaggaagatgaggtggtttgtaaaggctcattaagtaaaactcaagatgtttaccatgacaagtcccctcctggtatcttggtctcactgccacccagtctggagtgcagtgtaggaggcaacctctgcctcccaggctcaagcagtcctttcgcctcagccttctaaggagctaggacctcaggtacgtgccaccacacctggctaatttttgtatttttttgtggagactgtgtttctccatgttgcccaggctggtcttgaactcctgggctcaagtgatctgcccaccttggcctcccaaagtgctgggaatacagacatgagccaccacacccagccccagctgtttgtgattaattagtcttggggaacgatgacttttggatgtatatctgtggatccaaaggctcttacggcttagttaagtactctttgttaatgaacagtctgttccatggtgaagtatcattttccataactgggttaatcatcatttcttcttatactaaaaagaatttttatgtcactcctagctagctctcattagtaaagtaagtcccctgttttgcgtgggaagtggtacagtttcatggccagtatgcttataaacatttgtcagagaaattgagcacacctcaggaaatgtttagtgggttgaatgcccagggaagctgttaaacatttta

SEQ ID NO: 1862 - DNA, 943 bp, Homo sapiens
agggtgtgttttctttcaggaatggctacaagtttctgtactgctcggctcgtgccatcggcatggccgacatgacccgtggctacctgcactgggtcaatgacaagggcacaatcttgccccggggccccctgatgctgtcccccagcagcttgttctccgccttccacaggtacctctccggcaggcagccctctgcccaccgccccagcatgtgggcggggctgggcccaaggtggggggatgtgtgggaacagaagtcagatgttggagccgccacgcctctcccagttctttggtccctggtggtgtcctaccacatactgctcacttgccatgtggcgggcctggtgaagaaaggcaggttctaggaaccgtcaagttttctccttccctaaacttcatcactcaaattttcttagttatcagactggcaaagaaggagaaggaaagattccagttacaaagggttgaagaaattgggtggttgtgagcactaaaattttaggaccactcactggggaaaacgaccattttgagattggtgattgtatttgtatttttttcttagagaagtgatagaaaagaaaccagagaagttcaaaattgagtgtctaaatgatatcaagaatctgtttgccccgtctaagcagcccttctatgctgcctttggaaaccgtccaaatgtgagtatctcctgggctctgggttctgatgtgggtgaaattcagagggatgtacttcgtggggtgtagccacgtcccaattctcaaagcagttttgtaagcaaaatgaggcatctgttctgcttgttcggttttcacttgatctattccaaatatctatagcaactggggaggtcctgcaggtgcagatctgccccagaatttatacgaaggacgcttttccatcgtttctgtggctgccattccatttcctcagg

SEQ ID NO: 1863 - DNA, 208 bp, Homo sapiens
attcagctgatcatctttattgaaaagaataagcaattttatatgtcacttccctcctccctccctccctgattccctcccctctctcttgctcactttcactgtgtaatggttttgcacaatttttgtttctcacagttactataactgggctttggcagctcccatgatccttagcttgcaagtattccagaagagcttgcctaag

SEQ ID NO: 1864 - DNA, 371 bp, Homo sapiens
tttgggggatattttaaagctgacaagaatgtcatcgttcctgcctttctttggtttctccttcacagaggatcttcaaatgcttccttgaaagaagaagaatgtaaagagcctttgctcttccattctggggatcattaccccttatctgatggagattggtcccctttagagacgtaagtatctttgaaatttcttggtttcttgaaagaggaaggagatgtattaattagcttttctgttaatctgtagtaatgatatttcccatttctctcacacagccaaggaactgaatgtttacttgtaacataaatatgaatcttttctctcaataattattttgtttctaaatttgatctgacttactctaa

SEQ ID NO: 1865 - DNA, 453 bp, Homo sapiens
cccctgtgcttgctcactggcttccccactccttggggcctcagctgggaaccctgccctgacacccccaggcaagctgtccctgccctgcaggtaaccacactgtccaataagagcctattgattcctctgtttcccgaggcatgtgaactccgcaacccccactatggctgatttggtcatctttgtgcctcctgcatctggcagtgggcctggtaggtcagagctccacacatatttgttgtctgaaggaggagaagccccccactgccccaccacacgcacgcgcacacacacccacacacacacaccctgccgctgtaaacatgcaatcgaaacacgggacacaggccaggcgcagtggctcacacctgtaatcccagcacattgggaaatagcttgagcccaggagttagagaccagcctgagcgagatagcgagaccctgtattta

SEQ ID NO: 1866 - DNA, 514 bp, Homo sapiens
ggccgagaaggcgacgcccctggcgcccaaaggggccgctccgggagctgtccagcctgtggctggtgctgaagcggcccccgccgcgaccctggccgctttgggcggcaggaggcccggaccgcccgaggagccgcctcgggagctagagtccgtgccctcgaaactcggggaaccccctccgctcggagaagggggaggagggggcggggaaggaggaggagccggcggcggctccggggaaagggaggggggcgctccgcagccgccgccgcccaggggctggcgagggaaaggcgtacgcgctcagcagaggggcggcagcggcggggagggggcctccccttctccatcctcctcttctgcgggcaaaaccccaggaaccggcagcagaaactccggaagcggcgttgcggggggcggcagcggtggtggagggagctactggaaagaaggatgtctgcagtctgagctcatccagttccatctcaagaaggagcgggcggcagcggcg

SEQ ID NO: 1867 - DNA, 955 bp, Homo sapiens
ctgcaacctctgcctcctgggttcaagcgattctccatctcagcctcctgagtagctggaactacaggtgtgtgccacaaggcctggctaatttttgtattttttgtggagacagggtttcatcatgttcaccaggctggtctcgaactcctgaactcaagccatccaccctcctcagcttctcaaagtgctgggattacaggcatgagctatcatgcctgacctctttgcacattctcttgatctgttatgctgtttgttgccatctactgttgtcaaattctacctacccttcagggtccaactgaaatgccacattaccaggaaaggtttttctcattgtccctgccatacttcatttctcttctgcccttctgtagctcaggaccctctttaggtgtcactcccattagattgtaagtttcctaacaagacgcacgtcatcgtctccaaatcctttgggtcagcacagcctcttttatattaccagtctaagcccctttgtgtgacatttaaagtccgcctggactgactgttcagcctcatcctctgcccttcccttgtgtcctgggctctggccaaatcaaaccaccgttccccaaatgtactatgtagttaacttttaatattgcttctttttattgccttggttctctcaaaaatcagaattaatggaatgttggctattacaattacgtggacatggttatataatggccttggcgatgcccttaataaatgaaatctaaaatgttacattttttttggaacccagaaactcattctaattttattctgcctgaggctttatagcattttctgaagatcatgttgtactcttctttcgtctagatgatttggtcaacagtgataaagttccaacttagacttgataaatatgcaagagtcatgaaatatgaatgaaaacagtgacttttgaaaatcacgcttacct

SEQ ID NO: 1868 - DNA, 491 bp, Homo sapiens
gccaagttacagagcagactttctgggctagtcctgcttccccactttggctgttctcagggatatttctcccttctggcactcccaatgcttcccatggtttgagatgacagatgagtcttttgcctgtgaatagccactgcactccagccttatggtaaaatgtgcataacatttaatctttttttttttttgtctcactctgtcacccaggctgcagtgcactggcatgatctcggctcactgcaaccttagcctcccgggttcaagtgattctcctgcctcagtctcccaagtagctggattacaggcatgtgccaccatgcctggctaatttttgtatttttagtagagacagggttttgccatgttggccaggctggtctcgaactcctgacctcaagtgatctacctgcctcagcctcccaaagtgctggaattaccatgagctacctccagccttggggggcacaggaagcccttgtctcagg

SEQ ID NO: 1869 - DNA, 461 bp, Homo sapiens
ctgtgttctgattgtaggattgagcaaatgtgtaaatatattgaagatgtcaggagtcaggttgctcactgtcagaaagaagacacaatataggaagaaagaaaactggcaggaaccctgtggtattgaattgaaataatggaacttgagttattagtatgaactcatggtttttaataaatacatagaaatagatgtaaatatatttgtgtatctgtacacttcagggcctagaacttcttttctggctaaaaagtaagaaagtgcttaaaaacagaataaggatgtaaacaaacctaacaaaaaaacacacaggcaggcctgttttgtgaggctacaacaactcaaacctgggacaattttagcattaaaataaatatgatagttcttgcagtgaaaaaaaagtcgacgcggccgcgaatttagtagtagtagtcgaaccgggaattcccgaccggtac

SEQ ID NO: 1870 - DNA, 503 bp, Homo sapiens
gtggaatgtgtccatcagttcccaactctcagttcaaccacttcacctgggcagctccaatgtggcaggagtattttcaccaaagaaattaaatgctacaaatcctaccaccacaccactggtttgggctcatagaaagtttgttaagagtctgtgacatgaggtggcctctaatacagtgagttcaatatttgaacttctgtaaagaaaaggattagatttattcagtatgatcttaaagagggatgctaggggcagcaggtaaaaatttcagggagacagattttcgttcagtgttgggaaactcctgaggtaagaagtgcccattaggctgggtggccactcaccttagaagagagatactacagagaaggctgaaacatggaagattgtaggggttgagtggctcattagtttggccaccaaatctagcaaataaaagtacaggatgccgagataaatttgacaaaaggctgtaactgccaagtttttgtaattcattg

SEQ ID NO: 1871 - DNA, 366 bp, Homo sapiens
gcaggaggaacattagctgttcccaaatcgaagggaaaaggtacctaaatatatatctcaaatttgttttttgattctagaattgacataagattggctgggcgcagtggcttatgcttgtaatcccaacactttgggaggctgagacaggtgaattgcttgagtccaggactttgagaccagcctgggcaacatggtgaaactctgtctctacaaaaaatatgaagatatttttgtattttttagctgggtgtggtggcgcacacctgtgtcccagctatggggaagggtgcggctgaggcaggaggatcccttaagccccagaggtcaaggctgcagtgagccctgatcatgagaccttgtctt

SEQ ID NO: 1872 - DNA, 532 bp, Homo sapiens
ctgggtgtggtgacaggcgcctataaccccagctatttgggaggctgaggcagtagaatcgcttgaacccagatagcagaggttgcagtgagctgagagtgtgccattgcagagagactccatcccaaaaaaagacagctgtcccaggccaagggtacttgggagagcccctcatggagaacctagtttagaccaagtagcagaagctgtggtcataacaaaacaatttgaggaagaaatcttacaaatcaccactgccctttctccttttccataaaactgtccatcttttcggtgctccctaatccaagcagcttgactttagagaagttgcagaagcagtgaagccactaacatgctgtgtgactttatgcaagtcactcacctcactgagccacctccatttcttcatctgtgaaataggcataacagtaatacataaccctacctacctcacagggctgttgtgaggatcaaatgaaataatgtaacgtgagaatacagtataaatgataaaggattgttattcttt

SEQ ID NO: 1873 - DNA, 402 bp, Homo sapiens
  misc_feature (18)..(18): n is a, c, g, or t
  misc_feature (38)..(38): n is a, c, g, or t
acctagttatgaccacancttctgctacttggtctaanctaggttctccatgaggggctctcccaagtagcagaagctgtggtcataacaaaacaatttgaggaagaaatcttacaaatcaccactgccctttctccttttccataaaactgtccatcttttcggtgctccctaatccaagcagcttgactttagagaagttgcagaagcagtgaagccactaacatgctgtgtgactttatgcaagtcactcacctcactgagccacctccatttcttcatctgtgaaataggcataacagtaatacataaccctacctacctcacagggctgttgtgaggatcaaatgaaataatgtaacgtgagaatacagtataaatgataaaggattgttattcttt

SEQ ID NO: 1874 - DNA, 324 bp, Homo sapiens
tggagggatggttgacttgattgaagtgcattgccatggccacttttttttacttacacgtagacatcaaagagagaatctacttgtttcgttccatcttaatcatctatattttccccttttgatgatgcattgttatactattattgtctgtgctacatttttgccattcacaaattgctcctagttggtggaatgtagttacatcaagatgtggtcctgtgccagctttgtcctttttgggccaaggttttaatacaagtatccttataagccatgtgctggagtgctgagcttgctggctggtagagaggaaaattttgc

SEQ ID NO: 1875 - DNA, 386 bp, Homo sapiens
tttttttgagacagagtcttgctctgtcgcccaggctggagtgcagtggctcgatctcggctcacagcaagctccgccccacgggttcacacctttctcctgcctcagccttccgagtagctgggactacaggcgcccgccaccacgcccggctaatgttttgtattttagtagagacggggtttcaccatgtcagccaggatggtctcgatctcctgacctcatgatctgcctgcctcggcctcccaaagtgctgggattacaggcatgagccaccgcgcccggcccctgattgattcttgcattggtgattgcttcatgcatgacttactgagttttggaaagaaacagtcctgtgtaaagccaatgaaacagcactagtactt

SEQ ID NO: 1876 - DNA, 575 bp, Homo sapiens
cctgggttcaagtgattctcctgtctcagcctcccgagtagctgggactataggcatgcaccagcacgcccagctaatttttgtatttttagtagagacggggtttcaccattttggccaggttggtctcagactcctgacctcaagtgatccacccacctcagcctcccaaagtgctgagattacaggtgtgagccacctagcctaacctcgagttgatttttatataaaataagagagagagtggttcagtttcattctttctgcagatggctatccaattttctcagcaccatttactgaataggttgtcctttcccagtgtacgtttttgtctactttgccaaagatcagttggctgtagatttgtggctttatttctagtttctgcattctgttccattgatctatgtgtctatttttataccagtaccatgctgttttggttactatagctttgtttcccaatgttggaggagggacctactgggagatgtttgggtcacaggggcagatccctgataaatggcttggtgccttccccatggtaatgagttcacatgacagctggttgt

SEQ ID NO: 1877 - DNA, 125 bp, Homo sapiens
tccattttcaatgctagacagatccttagaaaatatgtcagatcatgtcactctgatgcttaaaaccctccaaagtctgcctgtctcatctgaagtaaaagtcaaagtccttctgatggccctcc

SEQ ID NO: 1878 - DNA, 285 bp, Homo sapiens
agctgagatcacgccactgtactccagcccgggtgacagagtgagaccctgtctcaaaaaaaaaaaaaaaaaaaatgaaagtaagtaaacatatctatatggcacagtggggtaaatttgagggattttagggacatcttacatgggcctaggctaaaatagtcattgtgttttctttatattatataattactataaaactaccaagagaaagacagtaaatgttaaatttctataaaacttccaaaataaaatgttttaacatgttttaatgaggaacttggt

SEQ ID NO: 1879 - DNA, 408 bp, Homo sapiens
cagcctgctgagtagctgggactacaggctcacaccaccatgccagctaatttttctttttttaaatttgaaattatattcctgttgcttaagattactaaggcagacttttttttaaaccaaaatattcagtctccatagagactgtcagaaatggtcagtgctggctgggcacggtggctcatgcctgtaatcccagccctttgggaggctgaggcgggtggatcatttgaggtcaggagtttgagaccagcctagccaacatggtgaaaccttgtttctactaaaaatacaaaaatcagccgggcgtggtggcaggcagctgtaatcccagctacttaggaggctgaggcaggagaatcgcttgaacccaggaggcagaggttgtagagagccgaggtcatgcca

SEQ ID NO: 1880 - DNA, 1218 bp, Homo sapiens
gaaataaactctagattccactttttgatggaaaaatggccaggtcatcattgcaaacgagcgtgaagaatggaatatactggtgtggtcttttttggaaatacaacctaccacagccagagtgtatgtctacgtatgtaatttaaaataagatggtcaggggaggccttcagagacagtgacatttgagcaaagacctgaagaagaagagaggaagccttgcagatatttgggatgaaagcgttacacactgaaataattgtaaatacaaaaactctgatgtggtaatgagcctggtctacccaagggatgataaggaggccactgtgactgaagtagagggccaagaaggaaggaataagtagttagaggtgaggtcaaagaagtcatgaaagccagatcatgtagggcttagaggaacctagagaaaggaatgtttggttaaaaggataaataattgtgtttccaacaggtgtccatagaataggcccttcctatgtggtagtaacaaaaataagtaaaaacttgagaaagaatctcctcactccccccccccaaattcctgccagataattccataactagttcctgtccacgggcaactctattccacttcctgaagtatagttttcacagggaggcggcacagcctgttagaaaagtttgcctctactcctcaaaccctgctctatgtgaatgaattatcacatacatatgaatctaattttcatttcagatactgtccaacttcccaccttaccaacttaggaaaacttcatctttcttttcagttttatagatgatgtcattgttgattttaaattataaaatggaatgcttccaaaggaggttacagttcctgctgcaatatatcagtcttagaacatgaacaacttgtaattgttaagtgcatgttcaaagctaattgtgtggcatttggttgctgcttttcaggaaaacttttaaaagcagagtatattctgagcagtctaataagcaacaatggagcaacgggtgagtactttcatatcttcacaatgacttttacctcagccccgaacagagcactcatttaataacaacttagtgacttaatagttactataccttagatgtttccagagctatctggggctgctctgccactgatgaatgaagaagctttgatcaagcagcttacatctctgtgtctctgttttctctaagttaaaaaaaaaa

SEQ ID NO: 1881 - DNA, 1633 bp, Homo sapiens
taattcctacttcctgaaactgaagccgttttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtacttcggccttcaaggggctcctttattgagaatcaatgtcttctcctaggtaattgatcaccctagacccagggacacccaattcatcgtaatcatcatgaataatcaaaaagtggtagctgtgctactgcaagagtgcaagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggatcccatccagccaaacactcaatgtagtgggatgtcagaagcaagagaagacccacaaggccaggcactatggctcatgcctgtaatcccagcactttgggaggccgaagcgtgtggatcacctgaagtcaggagttcgagaccagcctggacaacatgatgaaaccccatctctactgaaaactacaaaaattagccaggcgtggtggcagccgcctgtaatcccagctacttaggaggctgaggcaggagaatcacttgaactccggaggtggaagttgcagtgaggtgagatcaaatgcaaaactatactctagagaagtatccacacccagggccatgggaatctcacaggaaaatattcttggcaaaagatgaccttacattaaaattataagcaacaggctgggcagcggctcacgcctgtaaacccagcattttgggaggccaaggcgggtggattacctgaagtcaggagttcgagaccagcctggctaacatggtgaaaccccatctctattaaaaatacaaaaaattagcctggtgtggtggcaggcgcacgaaatcccagctacttgggaggctgaggcgggagaattgcttgaacccagaaggcagaggttgcagtgagctgagattatgccattgcactccagcctgggttacagtgagactctgtctcaaaaaaaaaaagaaagaaagaaaacaaaaaagaaaaaaaaagagaaagtaatagtaattgatggggaattccccacagaacaggcagcgcatgcaagtttgtttttatatagacaggatacaagaattcaactacaaaaccatggctgaagagcacagaacaccctcccggttggtgagataagcttttggcatttcacctgctagtaagggtgcccaactgccaaccagactgcttcaatggggtgaatgagataaaataaatcctta

SEQ ID NO: 1882 - DNA, 1490 bp, Homo sapiens
gaaataaactctagattccactttttgatggaaaaatggccaggtcatcattgcaaacgagcgtgaagaatggaatatactggtgtggtcttttttggaaatacaacctaccacagccagagtgtatgtctacgtatgtaatttaaaataagatggtcaggggaggccttcagagacagtgacatttgagcaaagacctgaagaagaagagaggaagccttgcagatatttgggatgaaagcgttacacactgaaataattgtaaatacaaaaactctgatgtggtaatgagcctggtctacccaagggatgataaggaggccactgtgactgaagtagagggccaagaaggaaggaataagtagttagaggtgaggtcaaagaagtcatgaaagccagatcatgtagggcttagaggaacctagagaaaggaatgtttggttaaaaggataaataattgtgtttccaacaggtgtccatagaataggcccttcctatgtggtagtaacaaaaataagtaaaaacttgagaaagaatctcctcactccccccccccaaattcctgccagataattccataactagttcctgtccacgggcaactctattccacttcctgaagtatagttttcacagggaggcggcacagcctgttagaaaagtttgcctctactcctcaaaccctgctctatgtgaatgaattatcacatacatatgaatctaattttcatttcagatactgtccaacttcccaccttaccaacttaggaaaacttcatctttcttttcagttttatagatgatgtcattgttgattttaaattataaaatggaatgcttccaaaggaggttacagttcctgctgcaatatatcagtcttagaacatgaacaacttgtaattgttaagtgcatgttcaaagctaattgtgtggcatttggttgctgcttttcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctgggtacaatcatgtaaaacttgcatttctcaaggctcatttacaaagcctggctgcatggtttcactgtggaattttcttcttttatcaggctaaaattgttaatttccacttgccttagtttcctcatcgaaaagagaatggcatttaagatcctaggagtgtcacaaatattaataaaatgtgtttttttctagtgagttttgttagagaggttcacggttgtatattgtaatgttaactgtagggttcccagtgttatttctagcatctgactcagttcagcaggactccatgtgatatggtgacaccttatactatacccaccgtgacactgttttcgttcattccttaaggtatacatgacactttgttcatgtatacatgatgct

SEQ ID NO: 1883 - DNA, 1366 bp, Homo sapiens
aagcagagtgtcatgaactaatgtggaagttctcccagatgatgatgattgaaagaagaaaacagcagaacaatatgtttagtgtgacgtcatttacgtatgagagagaaagagataggaaggctgtgggttttgttgtattaatgaaaatgcctcccacgctaagcctggccctcagcctgccagcgtttccgcctggctcacgatgttccacgctgttcctccaggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggatcccatccagccaaacactcaatgtagtgggatgtcagaagcaagagaagacccacaaggccaggcactatggctcatgcctgtaatcccagcactttgggaggccgaagcgtgtggatcacctgaagtcaggagttcgagaccagcctggacaacatgatgaaaccccatctctactgaaaactacaaaaattagccaggcgtggtggcagccgcctgtaatcccagctacttaggaggctgaggcaggagaatcacttgaactccggaggtggaagttgcagtgaggtgagatcacaccattgtactccagcctggggcacaagatcaagacttcgtctcaaaaaaaaaaaaagagagacgactcacaaggcctgctcacctcactcttgcctgaaattgggagacaaaacctttcaaaccacagttacagataaaggctcagatttccaattccatcaacatggaggactgagcacgtgcagaatcttctcccattacacatacataaatatggtgaattaaagatttgtaggtacctgaaacataaaaggtatttaaaatcacagcaatagactactgcttacgacacatagccaaaggaacttacacttgagcaaagtcctcaagggaaggggctgtcattttaatccctgggcagagatgagagacaattgccttgtgcccatgtgagaagtaaaatatttgcatcaagctggaattcttaaaggtttgcacaggctacaaaaggagactgaacaatcccaccagcctgcccagagaagttacaaggacgcttgctctccgcccaagctctgggatggaggggaaaaaaactctcatctaaaataaaggtctcaactctgtgccgaatttgagtgtggagtctgaatttactctgcccacaaagcaggaaacctgccatcaaataattaaga

SEQ ID NO: 1884 - DNA, 757 bp, Homo sapiens
taattcctacttcctgaaactgaagccgttttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggtaggaagagccacaccacctgttcctctgatatccccaagtgaggcatttagactctaagtggtctaatagattaaatttctttgaagcacaagacagccccctacccttatgctcagctctgccagattgactaatgtgagggaaatagctgtttgaaaaacattacttgcccataagatcttgtgttgtaaagccaaatccagtaaaagtgaagagtggtcagtgagtctaacatgaaccctgtcatct

SEQ ID NO: 1885 - DNA, 398 bp, Homo sapiens
tttggatttgtcctctgaatcatccttccttgtctataaaatgcatgtatatactcatacatacatagagagaaagagagagagagagagagagagactccagcctgggttacagtgagactctgtctcaaaaaaaaaaagaaagaaagaaaacaaaaaagaaaaaaaaagagaaagtaatagtaattgatggggaattccccacagaacaggcagcgcatgcaagtttgtttttatatagacaggatacaagaattcaactacaaaaccatggctgaagagcacagaacaccctcccggttggtgagataagcttttggcatttcacctgctagtaagggtgcccaactgccaaccagactgcttcaatggggtgaatgagataaaataaatcctta

SEQ ID NO: 1886 - DNA, 237 bp, Homo sapiens
taattcctacttcctgaaactgaagccgttttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttggctccccagtcctggtctcctgccctacacagtccaagcaagtgggccaagagattg

SEQ ID NO: 1887 - DNA, 4479 bp, Homo sapiens
  misc_feature (905)..(905): n is a, c, g, or t
taattcctacttcctgaaactgaagccgttttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtacttcggccttcaaggggctcctttattgagaatcaatgtcttctcctaggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctgggnatgtggtacgaagcagcagagttaatatgggcctccattgtaggatatttggcacttcctcagccggataaaaagggcctctccacgtcgctaggtatactggcagacatctttgtttccatgagcaagaacgattatgaaaagtttaaaaacaatccacaaattaatttgagcctgctgaaggagtttgaccaccatttgctgtccgctgcagaagcctgcaagctggcagctgccttcagtgcctatacgccgctcttcgtgctcacagctgtgaatatccgtggcacgtgtttattgtcctacagtagttcaaatgactgtcctccagaattgaaaaacttacatctgtgtgaagccaaagaggcctttgagattggcctcctcaccaagagagatgatgagcctgttactggaaaacaggagcttcacagctttgtcaaagctgctttcggtctcaccacagtgcacagaaggctccatggggagacagggacggtccatgcagcaagtcagctctgtaaggaagcaatggggaagctgtacaatttcagcacttcctccagaagtcaggacagagaagctctgtctcaagaagttatgtctgtgattgcccaggtgaaggaacatttacaagttcaaagcttctcaaatgtagatgacagatcttatgttcccgagagtttcgagtgcaggttggataaacttatcttgcatgggcaaggggatttccaaaaaatccttgacacctattcacagcaccatacttcggtgtgtgaagtatttgaaagtgattgtggaaacaacaaaaatgaacagaaagatgcaaaaacaggagtctgcatcactgctctaaaaacagaaataaaaaacatagatactgtgagtactactcaagaaaagccacattgtcaaagagacacaggaatatcttcctccctaatgggtaagaatgttcagagggaactcagaaggggaggaaggagaaactggacccattctgatgcatttcgagtctccttggatcaagatgtggagactgagactgagccatcggactacagcaatgatgagggagctgttttcaacaagtctctgagtggcagccagacttccagtgcttggagcaacttatcagggtttagttcctctgcaagctgggaggaagtgaattatcacgttgacgacaggtcagccagaaaagagcctggcaaagaacatctggtggacactcagtgttccactgccttgtctgaggagctagagaatgacagggaaggcagagctatgcattcattgcgttcacagcttcatgatctctctcttcaggaacccaacaatgacaatttggagccttctcaaaatcagccacagcaacagatgcccttgacacccttctcgcctcataataccccaggcattttcttggcccctggtgcagggcttctagaaggagctccagaaggtatccaggaagtcagaaatatgggacccagaaatacttctgctcactccagaccctcatatcgttctgcttcttggtcttctgattctggtaggcccaagaatataggcacacatccttcagtccaaaaagaagaagcctttgaaataattgttgagtttccagaaaccaactgcgatgtcaaagacaggcaggggaaagagcagggagaagaaattagtgaaagaggcgcaggccctacatttaaagctagtccctcctgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcacggatgttccctgcacaaatgggcacggctctcatagactgtgcattctgagacagccgcctggtcagagggcggagacccccaattcctctgtaagcggtaacatcctcttccctgtcctcagcgaggactgcactaccacagaggaaggaaatcagcctggaaacatgctaaactgcagccagaactccagctcatcctcagtgtggtggctgaaatcacctgcattttccagtggttcttctgagggggacagcccttggtcctatctgaattccagtgggagttcttgggtttcattgccgggaaagatgaggaaagagatccttgaggctcgcaccttgcaacctgatgactttgaaaagctgttggcaggagtgaggcatgattggctgtttcagagactagagaatacgggggtttttaagcccagtcaactccaccgagcacatagtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcggcagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaagaatgggtcaggagaccgctgcttctgggcataagtcctgcaaggaaagcaacatggaaaacagccccaactcacccatgagggatgaaaagcactcttgagaaaggcatgtgttgtttaagccattgagattttagagctttttgtcactatctgtcaagactgatactactggggcttttcctattgatttgggagttctttacatattaaaaaaatgtgagcctttgtgatacgaattcaatttgttttcctgtcttttgacatttgactttgcataaaagtttatctgtgcataatttta

SEQ ID NO: 1888 - DNA, 4609 bp, Homo sapiens
  misc_feature (233)..(233): n is a, c, g, or t
  misc_feature (1035)..(1035): n is a, c, g, or t
cacgaggagcaggagcagcgggggatgacttccgatccgacacccccaaaatctcctggacaaagctgctgtctttgcgggataaacagaaaagggccagtccccacctcacccccagcccgccgccccgcaagtacctggggctggggagtcagtgaactctcttcagctgttcggctctcccggctcagagcgaggggaatcgaggagactgggcgcaggatgggggtggncacccggccgctgctcctccgcgcgggaagttcttctaaatcaggaatggattgaaatctaatgaaccgaaactttgggtacttcggccttcaaggggctcctttattgagaatcaatgtcttctcctaggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctgggnatgtggtacgaagcagcagagttaatatgggcctccattgtaggatatttggcacttcctcagccggataaaaagggcctctccacgtcgctaggtatactggcagacatctttgtttccatgagcaagaacgattatgaaaagtttaaaaacaatccacaaattaatttgagcctgctgaaggagtttgaccaccatttgctgtccgctgcagaagcctgcaagctggcagctgccttcagtgcctatacgccgctcttcgtgctcacagctgtgaatatccgtggcacgtgtttattgtcctacagtagttcaaatgactgtcctccagaattgaaaaacttacatctgtgtgaagccaaagaggcctttgagattggcctcctcaccaagagagatgatgagcctgttactggaaaacaggagcttcacagctttgtcaaagctgctttcggtctcaccacagtgcacagaaggctccatggggagacagggacggtccatgcagcaagtcagctctgtaaggaagcaatggggaagctgtacaatttcagcacttcctccagaagtcaggacagagaagctctgtctcaagaagttatgtctgtgattgcccaggtgaaggaacatttacaagttcaaagcttctcaaatgtagatgacagatcttatgttcccgagagtttcgagtgcaggttggataaacttatcttgcatgggcaaggggatttccaaaaaatccttgacacctattcacagcaccatacttcggtgtgtgaagtatttgaaagtgattgtggaaacaacaaaaatgaacagaaagatgcaaaaacaggagtctgcatcactgctctaaaaacagaaataaaaaacatagatactgtgagtactactcaagaaaagccacattgtcaaagagacacaggaatatcttcctccctaatgggtaagaatgttcagagggaactcagaaggggaggaaggagaaactggacccattctgatgcatttcgagtctccttggatcaagatgtggagactgagactgagccatcggactacagcaatgatgagggagctgttttcaacaagtctctgagtggcagccagacttccagtgcttggagcaacttatcagggtttagttcctctgcaagctgggaggaagtgaattatcacgttgacgacaggtcagccagaaaagagcctggcaaagaacatctggtggacactcagtgttccactgccttgtctgaggagctagagaatgacagggaaggcagagctatgcattcattgcgttcacagcttcatgatctctctcttcaggaacccaacaatgacaatttggagccttctcaaaatcagccacagcaacagatgcccttgacacccttctcgcctcataataccccaggcattttcttggcccctggtgcagggcttctagaaggagctccagaaggtatccaggaagtcagaaatatgggacccagaaatacttctgctcactccagaccctcatatcgttctgcttcttggtcttctgattctggtaggcccaagaatataggcacacatccttcagtccaaaaagaagaagcctttgaaataattgttgagtttccagaaaccaactgcgatgtcaaagacaggcaggggaaagagcagggagaagaaattagtgaaagaggcgcaggccctacatttaaagctagtccctcctgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcacggatgttccctgcacaaatgggcacggctctcatagactgtgcattctgagacagccgcctggtcagagggcggagacccccaattcctctgtaagcggtaacatcctcttccctgtcctcagcgaggactgcactaccacagaggaaggaaatcagcctggaaacatgctaaactgcagccagaactccagctcatcctcagtgtggtggctgaaatcacctgcattttccagtggttcttctgagggggacagcccttggtcctatctgaattccagtgggagttcttgggtttcattgccgggaaagatgaggaaagagatccttgaggctcgcaccttgcaacctgatgactttgaaaagctgttggcaggagtgaggcatgattggctgtttcagagactagagaatacgggggtttttaagcccagtcaactccaccgagcacatagtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcggcagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaagaatgggtcaggagaccgctgcttctgggcataagtcctgcaaggaaagcaacatggaaaacagccccaactcacccatgagggatgaaaagcactcttgagaaaggcatgtgttgtttaagccattgagattttagagctttttgtcactatctgtcaagactgatactactggggcttttcctattgatttgggagttctttacatattaaaaaaatgtgagcctttgtgatacgaattcaatttgttttcctgtcttttgacatttgactttgcataaaagtttatctgtgcataatttta

SEQ ID NO: 1889 - DNA, 5610 bp, Homo sapiens
  misc_feature (1103)..(1103): n is a, c, g, or t
  misc_feature (4896)..(4896): n is a, c, g, or t
  misc_feature (5229)..(5229): n is a, c, g, or t
gaaataaactctagattccactttttgatggaaaaatggccaggtcatcattgcaaacgagcgtgaagaatggaatatactggtgtggtcttttttggaaatacaacctaccacagccagagtgtatgtctacgtatgtaatttaaaataagatggtcaggggaggccttcagagacagtgacatttgagcaaagacctgaagaagaagagaggaagccttgcagatatttgggatgaaagcgttacacactgaaataattgtaaatacaaaaactctgatgtggtaatgagcctggtctacccaagggatgataaggaggccactgtgactgaagtagagggccaagaaggaaggaataagtagttagaggtgaggtcaaagaagtcatgaaagccagatcatgtagggcttagaggaacctagagaaaggaatgtttggttaaaaggataaataattgtgtttccaacaggtgtccatagaataggcccttcctatgtggtagtaacaaaaataagtaaaaacttgagaaagaatctcctcactccccccccccaaattcctgccagataattccataactagttcctgtccacgggcaactctattccacttcctgaagtatagttttcacagggaggcggcacagcctgttagaaaagtttgcctctactcctcaaaccctgctctatgtgaatgaattatcacatacatatgaatctaattttcatttcagatactgtccaacttcccaccttaccaacttaggaaaacttcatctttcttttcagttttatagatgatgtcattgttgattttaaattataaaatggaatgcttccaaaggaggttacagttcctgctgcaatatatcagtcttagaacatgaacaacttgtaattgttaagtgcatgttcaaagctaattgtgtggcatttggttgctgcttttcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctgggnatgtggtacgaagcagcagagttaatatgggcctccattgtaggatatttggcacttcctcagccggataaaaagggcctctccacgtcgctaggtatactggcagacatctttgtttccatgagcaagaacgattatgaaaagtttaaaaacaatccacaaattaatttgagcctgctgaaggagtttgaccaccatttgctgtccgctgcagaagcctgcaagctggcagctgccttcagtgcctatacgccgctcttcgtgctcacagctgtgaatatccgtggcacgtgtttattgtcctacagtagttcaaatgactgtcctccagaattgaaaaacttacatctgtgtgaagccaaagaggcctttgagattggcctcctcaccaagagagatgatgagcctgttactggaaaacaggagcttcacagctttgtcaaagctgctttcggtctcaccacagtgcacagaaggctccatggggagacagggacggtccatgcagcaagtcagctctgtaaggaagcaatggggaagctgtacaatttcagcacttcctccagaagtcaggacagagaagctctgtctcaagaagttatgtctgtgattgcccaggtgaaggaacatttacaagttcaaagcttctcaaatgtagatgacagatcttatgttcccgagagtttcgagtgcaggttggataaacttatcttgcatgggcaaggggatttccaaaaaatccttgacacctattcacagcaccatacttcggtgtgtgaagtatttgaaagtgattgtggaaacaacaaaaatgaacagaaagatgcaaaaacaggagtctgcatcactgctctaaaaacagaaataaaaaacatagatactgtgagtactactcaagaaaagccacattgtcaaagagacacaggaatatcttcctccctaatgggtaagaatgttcagagggaactcagaaggggaggaaggagaaactggacccattctgatgcatttcgagtctccttggatcaagatgtggagactgagactgagccatcggactacagcaatgatgagggagctgttttcaacaagtctctgagtggcagccagacttccagtgcttggagcaacttatcagggtttagttcctctgcaagctgggaggaagtgaattatcacgttgacgacaggtcagccagaaaagagcctggcaaagaacatctggtggacactcagtgttccactgccttgtctgaggagctagagaatgacagggaaggcagagctatgcattcattgcgttcacagcttcatgatctctctcttcaggaacccaacaatgacaatttggagccttctcaaaatcagccacagcaacagatgcccttgacacccttctcgcctcataataccccaggcattttcttggcccctggtgcagggcttctagaaggagctccagaaggtatccaggaagtcagaaatatgggacccagaaatacttctgctcactccagaccctcatatcgttctgcttcttggtcttctgattctggtaggcccaagaatataggcacacatccttcagtccaaaaagaagaagcctttgaaataattgttgagtttccagaaaccaactgcgatgtcaaagacaggcaggggaaagagcagggagaagaaattagtgaaagaggcgcaggccctacatttaaagctagtccctcctgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcacggatgttccctgcacaaatgggcacggctctcatagactgtgcattctgagacagccgcctggtcagagggcggagacccccaattcctctgtaagcggtaacatcctcttccctgtcctcagcgaggactgcactaccacagaggaaggaaatcagcctggaaacatgctaaactgcagccagaactccagctcatcctcagtgtggtggctgaaatcacctgcattttccagtggttcttctgagggggacagcccttggtcctatctgaattccagtgggagttcttgggtttcattgccgggaaagatgaggaaagagatccttgaggctcgcaccttgcaacctgatgactttgaaaagctgttggcaggagtgaggcatgattggctgtttcagagactagagaatacgggggtttttaagcccagtcaactccaccgagcacatagtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcggcagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaagaatgggtcaggagaccgctgcttctgggcataagtcctgcaaggaaagcaacatggaaaacagccccaactcacccatgagggatgaaaagcactcttgagaaaggcatgtgttgtttaagccattgagattttagagctttttgtcactatctgtcaagactgatactactggggcttttcctattgatttgggagttctttacatattaaaaaaatgtgagcctttgtgatacgaattcaatttgttttcctgtcttttgacatttgactttgcataaaagtttatctgtgcataattttatatgtagttgaattcatcaatcttttattttgtatggctttttggttatgtataatacttagatcctccttatactctgagtttctttctttttaattctcctgtatttccttctagtataattaaatctgtaaaaagtaagatggaagagtggtacagttttctttatccagtctgtccttgatgggcatttaggtagactggataaagaaaatgtgntacatatacaccatggaacactatgtgtattaatccactctcacactgctatgaagagatacctgagactgggtaatttagaaagaaaagaggtttaattaactcacagttccacatggctggggagacctcaggaaacttacaatcatggcagaaggcacctcttcatagggtagcaggagagagaatgagtgccagcaggggaaatgccagatgcttataaagccatcagatcttgtgagaattcattcactctcacgagaacagcatgggaaaaactgcctcaattacctcctaccaggtccttcccatgacacatgggaattatgggantacaattcgagatgagatttgggtggggacacaaagccaaaccatatcacaatgtaaccataaaaaagaatgagatcatgtcctttgcagggacatggatagagctggaggccattatttttagcaaactaatgcaagaacagaaaactaaataccacttgttctcacttataggtgagagctaagtgatgagagtaggtggacacatagagggaacaacacacaccagggcttatcagagggtggacagtgggaggagggagaggatcaggaaaaataactaatgggtactaggctgaatacctgggtgatgaagtaattcgcacaacaaacccccatgacacaaacctgcacatgtacccctgaacttaaaataaaagt

SEQ ID NO: 1890 - DNA, 5358 bp, Homo sapiens
  misc_feature (851)..(851): n is a, c, g, or t
  misc_feature (4644)..(4644): n is a, c, g, or t
  misc_feature (4977)..(4977): n is a, c, g, or t
taattcctacttcctgaaactgaagccgttttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtacttcggccttcaaggggctcctttattgagaatcaatgtcttctcctaggtaattgatcaccctagacccagggacacccaattcatcgtaatcatcatgaataatcagttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctgggnatgtggtacgaagcagcagagttaatatgggcctccattgtaggatatttggcacttcctcagccggataaaaagggcctctccacgtcgctaggtatactggcagacatctttgtttccatgagcaagaacgattatgaaaagtttaaaaacaatccacaaattaatttgagcctgctgaaggagtttgaccaccatttgctgtccgctgcagaagcctgcaagctggcagctgccttcagtgcctatacgccgctcttcgtgctcacagctgtgaatatccgtggcacgtgtttattgtcctacagtagttcaaatgactgtcctccagaattgaaaaacttacatctgtgtgaagccaaagaggcctttgagattggcctcctcaccaagagagatgatgagcctgttactggaaaacaggagcttcacagctttgtcaaagctgctttcggtctcaccacagtgcacagaaggctccatggggagacagggacggtccatgcagcaagtcagctctgtaaggaagcaatggggaagctgtacaatttcagcacttcctccagaagtcaggacagagaagctctgtctcaagaagttatgtctgtgattgcccaggtgaaggaacatttacaagttcaaagcttctcaaatgtagatgacagatcttatgttcccgagagtttcgagtgcaggttggataaacttatcttgcatgggcaaggggatttccaaaaaatccttgacacctattcacagcaccatacttcggtgtgtgaagtatttgaaagtgattgtggaaacaacaaaaatgaacagaaagatgcaaaaacaggagtctgcatcactgctctaaaaacagaaataaaaaacatagatactgtgagtactactcaagaaaagccacattgtcaaagagacacaggaatatcttcctccctaatgggtaagaatgttcagagggaactcagaaggggaggaaggagaaactggacccattctgatgcatttcgagtctccttggatcaagatgtggagactgagactgagccatcggactacagcaatgatgagggagctgttttcaacaagtctctgagtggcagccagacttccagtgcttggagcaacttatcagggtttagttcctctgcaagctgggaggaagtgaattatcacgttgacgacaggtcagccagaaaagagcctggcaaagaacatctggtggacactcagtgttccactgccttgtctgaggagctagagaatgacagggaaggcagagctatgcattcattgcgttcacagcttcatgatctctctcttcaggaacccaacaatgacaatttggagccttctcaaaatcagccacagcaacagatgcccttgacacccttctcgcctcataataccccaggcattttcttggcccctggtgcagggcttctagaaggagctccagaaggtatccaggaagtcagaaatatgggacccagaaatacttctgctcactccagaccctcatatcgttctgcttcttggtcttctgattctggtaggcccaagaatataggcacacatccttcagtccaaaaagaagaagcctttgaaataattgttgagtttccagaaaccaactgcgatgtcaaagacaggcaggggaaagagcagggagaagaaattagtgaaagaggcgcaggccctacatttaaagctagtccctcctgggttgacccagaaggagaaacagcagaaagcactgaagatgcacccttagactttcacagggtcctgcacaattctctgggaaacatttccatgctgccatgtagctccttcacccctaattggcctgttcaaaatcctgactccagaaaaagtggtggcccagtcgcagagcagggcatcgaccctgatgcctccacagtggatgaggaggggcaactgctcgacagcacggatgttccctgcacaaatgggcacggctctcatagactgtgcattctgagacagccgcctggtcagagggcggagacccccaattcctctgtaagcggtaacatcctcttccctgtcctcagcgaggactgcactaccacagaggaaggaaatcagcctggaaacatgctaaactgcagccagaactccagctcatcctcagtgtggtggctgaaatcacctgcattttccagtggttcttctgagggggacagcccttggtcctatctgaattccagtgggagttcttgggtttcattgccgggaaagatgaggaaagagatccttgaggctcgcaccttgcaacctgatgactttgaaaagctgttggcaggagtgaggcatgattggctgtttcagagactagagaatacgggggtttttaagcccagtcaactccaccgagcacatagtgctcttttgttaaaatattcaaaaaaatctgaactgtggacggcccaggaaactattgtctatttgggggactacttgactgtgaagaaaaaaggcagacaaagaaatgctttttgggttcatcatcttcatcaagaagaaattctggggaggtatgttgggaaagactataaggagcagaaggggctctggcaccacttcactgatgtggagcggcagatgaccgcacagcactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaagaatgggtcaggagaccgctgcttctgggcataagtcctgcaaggaaagcaacatggaaaacagccccaactcacccatgagggatgaaaagcactcttgagaaaggcatgtgttgtttaagccattgagattttagagctttttgtcactatctgtcaagactgatactactggggcttttcctattgatttgggagttctttacatattaaaaaaatgtgagcctttgtgatacgaattcaatttgttttcctgtcttttgacatttgactttgcataaaagtttatctgtgcataattttatatgtagttgaattcatcaatcttttattttgtatggctttttggttatgtataatacttagatcctccttatactctgagtttctttctttttaattctcctgtatttccttctagtataattaaatctgtaaaaagtaagatggaagagtggtacagttttctttatccagtctgtccttgatgggcatttaggtagactggataaagaaaatgtgntacatatacaccatggaacactatgtgtattaatccactctcacactgctatgaagagatacctgagactgggtaatttagaaagaaaagaggtttaattaactcacagttccacatggctggggagacctcaggaaacttacaatcatggcagaaggcacctcttcatagggtagcaggagagagaatgagtgccagcaggggaaatgccagatgcttataaagccatcagatcttgtgagaattcattcactctcacgagaacagcatgggaaaaactgcctcaattacctcctaccaggtccttcccatgacacatgggaattatgggantacaattcgagatgagatttgggtggggacacaaagccaaaccatatcacaatgtaaccataaaaaagaatgagatcatgtcctttgcagggacatggatagagctggaggccattatttttagcaaactaatgcaagaacagaaaactaaataccacttgttctcacttataggtgagagctaagtgatgagagtaggtggacacatagagggaacaacacacaccagggcttatcagagggtggacagtgggaggagggagaggatcaggaaaaataactaatgggtactaggctgaatacctgggtgatgaagtaattcgcacaacaaacccccatgacacaaacctgcacatgtacccctgaacttaaaataaaagt

SEQ ID NO: 1891 - DNA, 956 bp, Homo sapiens
  misc_feature (10)..(10): n is a, c, g, or t
atgatctcgnacccgtcagacgctgaactatgtgacagaatttaacaagagactctatgaacaaaacattcccacccagatattctacatcccatccacaatactactgattttagaggacaagacaataaagggatgtatcagtgtggagccttacatactgggagaatttgtaaaattgtcaaataacacgaaagtggtgaaaacagaatacaaagccacagaatatggcttggcctatggccatttttcttatgagttttctaatcatagagatgttgtggtcgatttacaaggttgggtaaccggtaatggaaaaggactcatctacctcacagatccccagattcactccgttgatcagaaagttttcactaccaattttggaaagagaggaattttttacttctttaataaccagcatgtggaatgtaatgaaatctgccatcgtctttctttgactagaccttcaatggagaaaccatgcacatagaatacggcacagtctggtcctttggggcttgggcagggccgtgacacaggttctggccaatgatttgcaagaggaattgatcagtatcactttaagtcctgcatttaattggcagcacaagatcctgcagagcctctttccctctgccacagttatcaagaatgggtcaggagaccgctgcttctgggcataagtcctgcaaggaaagcaacatggaaaacagccccaactcacccatgagggatgaaaagcactcttgagaaaggcatgtgttgtttaagccattgagattttagagctttttgtcactatctgtcaagactgatactactggggcttttcctattgatttgggagttctttacatattaaaaaaatgtgagcctttgtgatacgaattcaatttgttttcctgtcttttgacatttgactttgcataaaagtttatctgtgcataatttta

SEQ ID NO: 1892 - DNA, 1292 bp, Homo sapiens
taattcctacttcctgaaactgaagccgttttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtacttcggccttcaaggggctcctttattgagaatcaatgtcttctcctaggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggaaaacttttaaaagcagagtatattctgagcagtctaataagcaacaatggagcaacgggtacctggctgtacagaaatgaaagtgacaaggtcctggtgcagtcggtctgtatacagatcagagggcagattctgcaaaagctgggtacaatcatgtaaaacttgcatttctcaaggctcatttacaaagcctggctgcatggtttcactgtggaattttcttcttttatcaggctaaaattgttaatttccacttgccttagtttcctcatcgaaaagagaatggcatttaagatcctaggagtgtcacaaatattaataaaatgtgtttttttctagtgagttttgttagagaggttcacggttgtatattgtaatgttaactgtagggttcccagtgttatttctagcatctgactcagttcagcaggactccatgtgatatggtgacaccttatactatacccaccgtgacactgttttcgttcattccttaaggtatacatgacactttgttcatgtatacatgatgct

SEQ ID NO: 1893 - DNA, 1696 bp, Homo sapiens
taattcctacttcctgaaactgaagccgttttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtacttcggccttcaaggggctcctttattgagaatcaatgtcttctcctaggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggatcccatccagccaaacactcaatgtagtgggatgtcagaagcaagagaagacccacaaggccaggcactatggctcatgcctgtaatcccagcactttgggaggccgaagcgtgtggatcacctgaagtcaggagttcgagaccagcctggacaacatgatgaaaccccatctctactgaaaactacaaaaattagccaggcgtggtggcagccgcctgtaatcccagctacttaggaggctgaggcaggagaatcacttgaactccggaggtggaagttgcagtgaggtgagatcacaccattgtactccagcctggggcacaagatcaagacttcgtctcaaaaaaaaaaaaagagagacgactcacaaggcctgctcacctcactcttgcctgaaattgggagacaaaacctttcaaaccacagttacagataaaggctcagatttccaattccatcaacatggaggactgagcacgtgcagaatcttctcccattacacatacataaatatggtgaattaaagatttgtaggtacctgaaacataaaaggtatttaaaatcacagcaatagactactgcttacgacacatagccaaaggaacttacacttgagcaaagtcctcaagggaaggggctgtcattttaatccctgggcagagatgagagacaattgccttgtgcccatgtgagaagtaaaatatttgcatcaagctggaattcttaaaggtttgcacaggctacaaaaggagactgaacaatcccaccagcctgcccagagaagttacaaggacgcttgctctccgcccaagctctgggatggaggggaaaaaaactctcatctaaaataaaggtctcaactctgtgccgaatttgagtgtggagtctgaatttactctgcccacaaagcaggaaacctgccatcaaataattaaga

SEQ ID NO: 1894 - DNA, 612 bp, Homo sapiens
taattcctacttcctgaaactgaagccgttttatgagaaacagtgtgtttcagagaggctgtaccagaattaactctgctcagagttagatttgctggtcttaaagtacttttcctctttaagataaaagaagttcttctaaatcaggaatggattgaaatctaatgaaccgaaactttgggtacttcggccttcaaggggctcctttattgagaatcaatgtcttctcctaggtaattgatcaccctagacccagggacacccaattcatcgtaatcatcatgaataatcaaaaagtggtagctgtgctactgcaagagtgcaagcaagtgctggatcagctcttgttggaagcgccagatgtgtcggaagaggacaagagcgaggaccagcgctgcagagctttactccccagcgagttaaggaccctgatccaggaggcaaaggaaatgaagtggcccttcgtgcctgaaaagtggcagtacaaacaagccgtgggcccagaggacaaaacaaacctgaaggatgtgattggcgccgggttgcagcagttactggcgtacctgaggctccatcctcgctcgggactgggaacggtacacgagctcgatt

SEQ ID NO: 1895 - DNA, 215 bp, Homo sapiens
agaaagttttcactaccaattttggaaagagaggaattttttacttctttaataaccagcatgtggaatgtaatgaaatctgccatcgtctttctttgactagaccttcaatggagaaaccatgtaagtcataggctgtatggattggtaatgtgacagaccttagtgatgctctcaaatatctggtgatgctcgcaaatatctggttctctcct

SEQ ID NO: 1896 - DNA, 855 bp, Homo sapiens
ccagtatatatatctgacaactgtctgatatatagactgtataaagcttacaactcagttgtaagacaactcagtaaaaactgggcaagagatttgaacaggcacttaatgaaagaagatatatgaatggctaatatgcaaattaaagccacagaaaataccacttcacatcaagaatggctaaaatgaaaagattgacaataagaagtgttggtgagaatgtggaacagttggaactctcacagtccttatgagaatgtaaaattgcacaaccacttggaaagcagtttggcagttgcttataaacataaacgtggcatgtgacccagcaatttctcttctaggtattcatccaagagaaatgaaaatatgcatcacaaaaacacttgcacattaatgttcatagcatctttagtcatgatagcctcaaactgaagcatcaagagataaatggataaacaaactgtggtatatctatacagtggaatactgtgcagccattaaaaaataatttctgaacttctgaaacacaaaacatggattcatttcagaaacatactaagtgaaaagtcagacaatgaagagtgtatattggctggttccatttgtatgaagttctacaaccagcagaactgatctacagtgatagaaatcatgagtagggtgtggtggagattgactgtagagggttgtgaagaaacgtcctgggccagtggaaatggtctttatctttagggaatctggttacatgagtgtatacatttgtcaaaactcatcaaactgtacatttaaagtgagtgcattgtatattaattatatttcaataaagtttattttttaaaaatgcaaaaaatg

SEQ ID NO: 1897 - DNA, 1322 bp, Homo sapiens
gaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcga

SEQ ID NO: 1898 - DNA, 1544 bp, Homo sapiens
gaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagcacatgctaggagaatactacagcagtctaacagaaatgcatgcaatgaagcgccagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggaggatccaaagtgggaattccctcggaagaacttggttcttggaaaaactctaggagaaggcgaatttggaaaagtggtcaaggcaacggccttccatctgaaaggcagagcagggtacaccacggtggccgtgaagatgctgaaagagaacgcctccccgagtgagcttcga

SEQ ID NO: 1899 - DNA, 1408 bp, Homo sapiens
  misc_feature (1220)..(1220): n is a, c, g, or t
gaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagttngtaaagttctttcataaacaacttggaagtatattacaggattcactggcaaaatttgctggcagaaaactgaaagactgtggagaagatcttcttgtagagatatctgaagtgtgttcaatgaattggctttctttaagcttatgcaagatttggataataatagtataactgttaaacagagatgc

SEQ ID NO: 1900 - DNA, 1432 bp, Homo sapiens
  misc_feature (1244)..(1244): n is a, c, g, or t
gaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagttngtaaagttctttcataaacaacttggaagtatattacaggattcactggcaaaatttgctggcagaaaactgaaagactgtggagaagatcttcttgtagagatatctgaagtgtgttcaatgaattggctttctttaagcttatgcaagatttggataataatagtataactgttaaacagagatgc

SEQ ID NO: 1901 - DNA, 809 bp, Homo sapiens
tgatgctgagcgcctccttcagcgcgtggtgcatgtgcagcatctcgtcgtgctgctgtgcctgctctgccaactcctccatcagtgtgttctggttcccacatgagtacatactggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacacgggcttctataccgcttcgactggaagatccacctccccactgccttttctcactcagatggggacaccgaggtccagaggaaaagacacctgtcaaatgtcacagatctgggaggggacttaagacctatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatc

SEQ ID NO: 1902 - DNA, 542 bp, Homo sapiens
gcaacctctgcctcccaggtagcttggattctcctgcctcagcctcctgagtagctgggattacaggcacatgccaccacacctggctaatttttttttgtatttttagtagaaaatacaaaaggttgttttgccacattggctggccaggctggtctcgaactcctgaccttaggtgatccacccgcctcagcctcccaaagtgctgggattacaagtgtgaaacaccataaaattatattttgatgaagcattagaatttggaattaaaaaaatttacattagtatcatgatctttttattgtagaaaattagaaagtgaaataatctttttatagactcaaggaaatcagtagtgctcttgtaggcagatttttgatgggaacctttactgtggtctgcatcatttgttaacacactgggggctgggcgtggtggctcatgcctgtaatcccagtattttgggaggccgacgggggcagatcatgaggtcaagagatcaagaccatcctggccaacatggtgaaaccctgtctctacta

SEQ ID NO: 1903 - DNA, 638 bp, Homo sapiens
tcattaaaagtatactttatttgtgctagtgatttcttctcatcacttcaacagagaaaaagaacattctagaatcctaacaatggtgacaaggggtgtggacacagcgttgttaggagggggagacaccagagcaccaacttctctcacttaaaccttatgacaaccttaagaagtaggcagcatgatccccttcttggaaatgcagaaagagagaatgggggagattgagaggcttgcagaatgtgacatcattagggagaacagtggttgaggtccagcagctcctgcagatgggtggtggtggaaggaggagagaatgggccacaggcaggccaagggcaagcttagcagcactcaacatcctccatgaactcaacagaagtcaagaatgcaggcagctcatgatgaagacctgcagcggcccaggtttaccaagctcattcacaattgcagttggagaattcgtctttggtcattttctactttggaaatacgagacaggatctccctctgttgtgcaggctggtctcaaactcctgccttcaagcgatcttcctgcctggcctcccaaagtgttggaattacaggcatgagccactgcacccgcccagtaaatcctttctgatacaccctta

SEQ ID NO: 1904 - DNA, 198 bp, Homo sapiens
cttctcagcctgcctcctgagcataaagaggcctgtttccacaccgagccgcctctctctgacggcacttccacaacagagctctctgcagaaaccctgtgtgtctcctgcgggcgtgactgagttaacccacacctgctcgctggggcaagctcttgtctccttgggctgagacccaggaggctgcggaagggcgcc

SEQ ID NO: 1905 - DNA, 233 bp, Homo sapiens
tgagcacttatttctcttgctctattcactttagagtactcagaggcctggtgggtgcctgggcctcctcaccaggggtagggtacatgttcctgctgcaagcaggattctgccaagaacagaatcagtgataggatgtacagaaaaagggtgcgttctcagggtctggagtggttaggtcagccccagtggggcagcataaagaaggcatgaagtgtaaggaggtgctttta

SEQ ID NO: 1906 - DNA, 366 bp, Homo sapiens
ctctctggctgctgcttctcagttggcttcaggtgttcatcttctttctctggccccttaaaagttaagtcctcagggccaggcacggtggctcatggctgtaatcccagcactttgggaggctgaggggggtggatcacgaggtcaagagatcgagaccatcctggccaacagggtaaaccccatctctactgaaaatacaaaaaaattagctgggtgtggtggtgcgtgcctgtagtcccagctactcaggaagctgaggcaggagaatcacttgaacctgggagatggaggttacagtgagccaagattgcaccactgcactccagcctggtgacagagtgagacttcgtctcaaaaaaaaaa

SEQ ID NO: 1907 - DNA, 612 bp, Homo sapiens
tttttcaagattgttttggttatttgaggtcccttgcaatcccgtatgaattttagaatcagcttgtgttgatgtctacaaagaagtcagttgggattctgatagggattgcattgaacttgtagatcattttggagagggttgtgagttgaattgtgtcccccaaaataatatgtgaaattctaactgtcagtacctgtatgtgtgatctcctgtggagatgggatctctgcagatgtcatcaaattaagatgaggtcatactggattaaagagagtcctaaatccaatgaatgggatccttataaggagagagagatttcgagacagagacacacagaatctggagacagagatacaagggggaaggccatatgaagacagatgcagggattggagttatgctgccacaggcaagtaacacctagggccaacagaagctggaagaggcaagaaagaattctcccttagggcctttggggagagtgtgaccctgccaacaccttgattttggacttctggcctctagaactgtgagaaaataaatttctgttgtgttaagccaccttgtttgtggtacttcattacagcagcactaggaaattaatacagg

SEQ ID NO: 1908 - DNA, 301 bp, Homo sapiens
cattctggcttccccgtgctgctgaccaagcgtggacagtttttggtttgctgttttaaagccaaggaaaggcccatgcttcctgtcttgagaaatttaaagtatggaatttggccaggtgtggtggctcacacctgtaatctcagcactttgggaggccagggtgggcagatcgcttgagctcaggagttcgagaccagcctgggtaacatgttgaaacttttggtacgaaaagtacaaaaattagccgtgatcatgccactgcactccagcctgggtgacagcgtgagaccctgcctca

SEQ ID NO: 1909 - DNA, 204 bp, Homo sapiens
ttttgttgttttctccccaaattttatattctcttttttccaggatagtcaaggtacatgtaagttttttaaagtacagattttgaattccaaccacaaataaaatgcaatcaacaaatactcactgagttcacatgatgaatgtgaattactatgaaatatataaactggccagtctggctgatttttagtatactgttcaca

SEQ ID NO: 1910 - DNA, 973 bp, Homo sapiens
gatttttgtttcactttcttggatttcaacaatatctctatatctcattgggccatgaccgtgggttgatgttttatataggctttgcttaggctgttgtgttccttcatagtctagccaagaattcagccatcgtaaagggacagcatagtacgtgcttgcttatgctaaacgttgggtcaaatacacttcattctcagaaggtttgactgagagcccttattactgcaagcttgaggtttggcacaatctcgaaggtgtcaagtttctcgcaacttttgaccttgtgatgtacacttagattttccattgatgagaaaattatgcatctgctattagagaaatgactgcactctcttggattgggtggtatggtaaactataactggtgatgaacacatttggaatggtttgagaacacagatttggttttaggccccatctaaaggtttgcatggtcatctgaacttgactcatctgatctcaatccggaccattgagtcagaaacacaaagcttgaaacctcgagagggaagactcctgacatttctagtcatgccagcttcccatcaagccagccacattcgatgaagtgtcctcaggcattttggcacgtccagttctgttcccggtccaggttgtggtttctttgaaagcagcaggtgtaggtggtaggtgcatggaaagaggccactgaacttcaaggagtttatgtcagggatcggctgcagggctgaggagagagggttgcagcattcaccttcctcagctcgtttgctatgtcctcctggaggagagagaaattcagcaggaataactggatttcatcgggtaaattccacaaatattgattaagtattccccaccccaccctgttctggtgagtcttcagtgtggccacaaatcacataagaaacttgttaaactgaaaatttacagcctagacaagaaagtgagacccccatctctaaaa

SEQ ID NO: 1911 - DNA, 567 bp, Homo sapiens
catttatttgcagagctctttggagtcactgtgcccaatttggttgtgacctggtgggcattcacagctgataggaagaaaaaaatgtggtaatcttagccatttcctgctgtaagaattgtgtttggaaaatgacctgcattcttaagtcaagaaaaagtgagacacaaggtacagctggaatgggacacaggactgagggagagtctggcggaactgaaacctgaatagctaggaaggtatgagcgtgttaagggagtgtgtgtcaagggcatagatgaggtgactgagctgagagatgacctaggagaatcagagcaatggtaagaactagcactgaccatccctactcatgctttaacaaataaagcttcaagatgttctaggatattctatctgctggttagaaatacatcttcagagtcagagctttagttttttccactattataaggaaatttctgtccatgtgagcttcatgtaatattggtattgacaatgatgatgatgattatagctactgtcttagtccattcaggttgctacataacaaaataatatagactt

SEQ ID NO: 1912 - DNA, 349 bp, Homo sapiens
ctttctgccctcatgaagctgacatatgcagaattagaaagaaaagggctctactgagtaaaattggttaagtgattttactggacagagttgttattatgtatattggccagaagaggccaggtaacaaatatgcacagacggtacagaagtgggacatgtgtaggatgtcatggatcttgtctaataagagccaagaaacctcagcagaaaaaaacgaagatagcagccaggtgcagtggtttacacctgggatccagtgcgttgggaggccaaggcaggaggattgcttgaggctaggagttcaaggcctgcctgggcaacacagcaagtccctctttctacaaaa

SEQ ID NO: 1913 - DNA, 353 bp, Homo sapiens
atttttagtagagatggggtttcaccatgttggtcaggctagtctcaaactcctgacctcaggtgatccacccgcctcggcctcccaaagtgctgggattacaggcatgagccaccgcaccaggccaagtttaggttctttagagtgaaacacctatacagtatttaaggaagcacttttccccagcaccaaccctggcttacaacattcagggagtaacttaaggttttggggtacttcactccctttacaccagtcctggccttgcctgcaagacagacacaccttccttttgcttttaccaaccctctctgaaaacctcttttttttttcttttttttttttttttgaga

SEQ ID NO: 1914 - DNA, 209 bp, Homo sapiens
gcccatctgacccacagcacgtgtgacccctagacagggcttctcctggcttgcagcacttggaaatcggtgctgccttacggaagtctgtgttggctcattttggctcctgagaacaacttcagctccttaacagcatctattttaggtataaatcccccccccgctcacttttggggctgtgtcatggcaaccattagtgtgagcaa

SEQ ID NO: 1915 - DNA, 277 bp, Homo sapiens
tccttctctgcaatcagatttctcagcctggtacattatgaacagcttagtgctgttgagtaatttatatcaggatgattaggaaagcttttctctgcagattttaatttttcttaaattaaaccactggctcaaacagaattttccttgaacccaagttttcacattagagatttgcataacttttaataattcttatccattttccttttctatcccctcttacctataattctcagtctttattctttcaaaaaaggaatgaatctcatcttta

SEQ ID NO: 1916 - DNA, 133 bp, Homo sapiens
ggggtttgtttaaacacataaaagtaataacgatagaggttttatgcccgtaggtatataaatctggtgagtgtgatttttaatttcagtgaatgtttcactccccacaataaatacgtttttatacctttca

SEQ ID NO: 1917 - DNA, 381 bp, Homo sapiens
ttaactaatattcaccataacaagagcagcctcaccacaattaatgtagatatactattgaaattgaaatacaatgtctaatatcccaagttcatgattttacttttagaataatatattcatgtcagggagccacctgtagttaagaattttataaactggaatactgcctcagtgttttgtttgctgctcagtattttgtttgttattattgtttgctggctgctgtaaccagaataccttagacttgctaatttatagacaacataactttagctctggaggctgggaagcccaagaaaaggcaccagcagatttggtgtctggtgggggctctctgcttcatacgttgtgccttgttactgtgtcactggtacaagg

SEQ ID NO: 1918 - DNA, 467 bp, Homo sapiens
ggttttttttgtttgttttgtgttttgagatggagtctcattctgtcaccaggctggagtacagtggtgcaatctcggctcactgcaacctccacctcttgggttcaagcgattctcctgcctcagcctccctagtagtagctgggattacaggtgcccaccaccacgtccagctaatctttgtatttttagtagagatggggtttcaccatgttgcccaggcttgtctggaattcctgacctcaggtgatccgcccgcctcagcctcccaaagttctgagattacaggtgtaagccactacaattgtgtttttttttgttgttgttaaatcttaggagttccctatatattctagatattaatcccttattagatacatgattttcaaatattttcatccattctgtaggttgccttttaattttgttggtagtgacttttgatgcataaaaattttaaattttca

SEQ ID NO: 1919 - DNA, 328 bp, Homo sapiens
ctgtctgtgggtcagtgggaattcccatagcattcagctgaagtgggacttcgcaataatctgcacgtgtagatcttcaaagaggggctgttgggagtatggtagcccctgagagaaagcccagaaggaggcatattaagtggccattcattctgctcatatagatgtatcttttctgaagatgaattttggattggacgcaatggctcatgcctgtaaaatcctagcactttggtaggccaagaagggcagattgcttgagcccaggaattttgagaccagcctgggcaacatgacaaaccccatctctacaaaaaatacaaaaaac

SEQ ID NO: 1920 - DNA, 287 bp, Homo sapiens
ttgctgaaaactactaatagttggtactttgttttcaattaactgtttttaaccaagataatgactttggtattaaaaccccttttttttttaaacccgtgtagtacaggaagaaaagtgaattggatatgattttgaggatatgggcatctcaaaataagctccagtggaacaaacaatacccttaaattctgattttgtttcctttatgtattttgatagttacttgttctgtagcagtatagcatagtggttaatagcaagggctctggagcatactaggttga

SEQ ID NO: 1921 - DNA, 268 bp, Homo sapiens
agaccgtgagggcgccaggagatctgcggctctctccccaacccaactgacgagtactccctcaaatacaactgtatcttttctgtcctacaacccacctgcctctgatgactacatgaaggctggagaaggcaaagagcctggagcacttcagaggcccaagccaatgggaaaagcggaaaagctacagcattcacacctgctagtgatccagtaaaccacacttgctctctgttatttatggggcagctggctgaaagaaggtaaa

SEQ ID NO: 1922 - DNA, 366 bp, Homo sapiens
cctcccaaggtgctggaattacagatgtgagccatctctcctgacctacacatactaatgtaaaagttgggaactacatggtatctactataacacatctcaaaatttcagtggcctattgtgactctgacctaaaagctcagcatagatgttcttggcaggtgggttgcatatttctctctttttgtgccttactattccctggggctttggagtcctctgaatctagctggcctatgaaaaagagaggatgaaaactctccattttgccacctttgcctggaagtgacgtatatcacttcctccagtgtttctggtagtgagaaatagtctcagtaacccatctagtaattgatagaaatggcc

SEQ ID NO: 1923 - DNA, 171 bp, Homo sapiens
tcatgggaaacggagagggagcagatgagagaccttgaaaccttccagcaaccttacccccacttccaaactcccgcgactaccccaagaccatttcggccaaatctcagtaactggcaccatcttgtactttgacctcaccaggcaaggcatcctctggggagaggggtt

SEQ ID NO: 1924 - DNA, 352 bp, Homo sapiens
agcgagaaggaagaagtaagccagccagcagctgtggcatgcactcccacatagcccttctctgacagttccctcagcacacagccctcagggaatgtaggctgcaaaatgtcaggaggtagaaatgtctgcaccggcaattgtaccaacagtgcgtatgtgtgctcactcccctgcagaaatgtgctgctgtgcagtgcaggctgacactgaacaaaactacatgcacacatacaaaaactgcaacttaggaaggtgtctccaaatgtgcagcaactctggtggaataaaattattagtatatttcatgccggagcaatgaatctcaattatctgttcacaagtaattcct

SEQ ID NO: 1925 - DNA, 362 bp, Homo sapiens
tgtatgaatataagcctataagggatgtgaatgaatgacacctattcagggatggtcttgatagatagttgtgagggaaatttatcccactgagcagagatttgggtggtgtcttatgccattcttgtgtcactagaaagaaatacttgagactgtgtaatttataaagaaaagaggtttaattggctcacggttctgcagactgtatggaaagcatgatgctgacatctgctccatttctggggaggcctcaggaaagttacaatcaaggcagaaggggaaggggaagcaggcatatcacatcgccagagcaggagcaagagggcgagtggagaggtgctatacactttttttcttttttt

SEQ ID NO: 1926 - DNA, 613 bp, Homo sapiens
tgagaaacgtgtttagtatttggtttagagtgacctcaaactttgcttccaagcacttcaacacacacctggcatagccacttttcagacctgttactagtattattttatattatggcagcctaataattagaatacatacaagagatattggctaaaactacaaccttaattcaaaatttctcaaagtgcattccatgaaatcttaataagttttacatacacatacaccaatggttttttggccaaatatgcttgagaaataatgactaaaaatcaaatgtttctttattgaaagacttcacagaaaccttaaaatcagactgcattgtgaatctccaagagatgagtaatgtctacatatttctcagacttatttgaccatagaacatctcacagatctagtgtcctgaggcacatgccttaggaaactgcttcagtggctttaagccaaaggaaaagacattgagtgtgatttcctcagtacagactctcactaacaaaaagttggatgataaaatcaaatgtactactcaggaggctgaggcaggaggatcagttcagcccaagagtttgagaccagattggcaacacagcaagacctcatctctaa

SEQ ID NO: 1927 - DNA, 497 bp, Homo sapiens
attggtaatgctgattcccaaccaccttgttccttccactggagggggctctctcaaccccttctctgaggatgtgaaaacaaacccagatgggtgtgcctatctcccatccttttggccctttagccagagtcctctggaacaaagcagggccagcagggccttccttgaagacttgccttggagagagagagagaggctggatggaatcttgaataaaaatgataggttatgctttaagctgaataaaaataagccatctgaagaatatatagaagtggcatgcatgctgcctctggaaagattcatttttatttgtctatctatgtataaaggaggaagatagataaatggaaagggaagtgccgtttctgtaatgttcactctggtgaagggtttgcaaacagtataaaaatagtggctcttccaaaatgacggctttacttgaagtttatccacctctctcccccttgctcatacccctcaccaaaaaaaaa

SEQ ID NO: 1928 - DNA, 170 bp, Homo sapiens
ataataataagtgctataaagggtggacagatatttaaactggggagtcagtgatgatggctgaattttatgtggaagcgcctggaggggcatttagttggaaagtgggaccagaggatttgtctcaaagaggtttttgcttaagttggcagtttattgggaagtggctt

SEQ ID NO: 1929 - DNA, 526 bp, Homo sapiens
cacaggggccctggtagagtgaccttgcacatctaggtaccagcgagccccaagtacacacttgctctgggcttgggtgcgtagatgggcaaggatggattgtctctaccattcctcaaccagctgaggccctgaaatcttcccttagccagatttcgggacaaaggagcactagatattattaaaaggactccttttgctagtcctttgaagcccgaattgggattgaaagtgagaggaacagggcctgggctcagaagggggatataaggaaagcagaacccagtgtgcctgtgtcagtgtcgtctggagaaaaagctcttgatgatatctaatagctgttattcacatcaaaactctctaaggccctccacctattttctcgtttatgggaaatgaaacattcagagaaaggacttgcccagtcacctcagatggctcagctggaaactagaagtgagatccgacatagtggaaatgtgtagcatacggtgagccactttccaacttagccattaaaaaaaaa

SEQ ID NO: 1930 - DNA, 433 bp, Homo sapiens
ttttttaagagacagagtcttgctctattgaccaggctggagtgcagtggcatgatcataactcactgcacttgggctcaggcaatcgtcctgcctcagcctcccaaagcgctgggatcacaagtgtgagccactgctcaataatattccatactacagatacactacattttgtttatccattcatccactcacctactattatttaattatccattcacccgacctattatttaattttaaaaaaatttacagactttattttttggagcagttttgcgtttagaaagaaattaagtgggaagtaacaaatcctcagtgctctgctctacctgatccccttcctctccgataacctctggccaccactgatcctttctgcatctctacagttttgcagaatgtcatgcagttggaatccttctgtatggag

SEQ ID NO: 1931 - DNA, 201 bp, Homo sapiens
ggaggttgcagtgagtggagatcatgccactttactccagcctgggcaacacagtgagactacgtttcaaaaaaaaaaaaatgcatcgagctatatacagacacacacagatgcgtgtgtataaagctggtgaaatctgaatgaggtttgtgaattgtgccaatgccagtgttctggtttggctattgttactatagttat

SEQ ID NO: 1932 - DNA, 445 bp, Homo sapiens
tttggatttggcctctaatgtttaggcacgagtcagcacacacagatgaatagattaactgagctaatttaagggagccctcccgtggaaggattcttttttagccttctatatttaggctaaggtttgtgcctgtgcaagacactgactgaagaactgagttttccaaacctcacgagcaaggactctctaccgtgagatcttcctaacaaacctctcacttgttcatgggagctctgatgtccccataaccacagagtattaaaacaggccaattatggcaagctcatttgtactgcagggtgactctcgcctcactttcaaaaatgtggtgagcacatactgtgttggtattcaggctagtgaatatccctatctggtgaaactcgataaaacttaatttgatatgacaactctattgaattctaccagaagcaatcacttc

SEQ ID NO: 1933 - DNA, 437 bp, Homo sapiens
tgtggaatattcatgaaagttattggaaaaaaagtgtcactgtggtgccacccatttttatgccaaatatgggtattcttggaactgttagggctctggtggctgtgtgatttgcataatgaggttctaggcgaagcctaggtcaaatccaatgtcatgttgagtccagttggtttaaccagcttcacatcctggtttttcaggatcttatcagcacataatttctgcagctatttcaacaagctattttactagtcatgtgaaactgctgcctggaattttctaatctcctgcaaccaccctgtattattcctgtctcagtaacatagtaagggatcataataaaagcatggataattagcctctttcaatgtatattctggaagagattcacaggtcttgatgactgcttaaatctaggatcacaggatctctgg

SEQ ID NO: 1934 - DNA, 294 bp, Homo sapiens
gatgccaggccagggagctacagaggttttccctgggcaccatgggcagccagagaagtacattatgttgggatcagtgtgatagaagatgggggcagaggaggaactgcaaggccaggggcactcgcagccttaaccaggcaagagctggcgagactgggcagggcgaggtcgagaggaagaggagagggtgggtcttccttcctgcagtgctgcctgaagccccttgcccagaagaggctggctatgagggcagcagggggactacagggagaggaagaggctggaccaaca

SEQ ID NO: 1935 - DNA, 530 bp, Homo sapiens
tctatttagcaatggaggcccccactgcacctgtcattcttttttcatatcctacaagtaaaaacaaattcaacaaggcactctggtgcaatgcagtctggatttgccagctgtttatagaagttgtctgaaagtgccaactgcctggcccttggagcccacaggacagaagagaccttcttgtcaggggaagaactgctaaggccatgggctaggttcagatgcagcttctccaatagagaggagataggaatctcccatccagcccaagcaacctagggaaagcccctggggtcactttagacaattctgctccttccaccaagcgagcaaactgaggctcggagcttaaggcaggtgggaaagatcacatacctcagaggtggtggagtccagattctagatcaggctcttcctaccatgctgtatgtcacaatcaccctcattatccaatccagggtcctctgcagctgtgtgcaggcctcattctctcatggaggggccccccggagtcagcccacccataggta

SEQ ID NO: 1936 - DNA, 92 bp, Homo sapiens
ttatacacaaatatgcatgacagctttattttaatagcaaaaaaagaaactacaaacaactcaagtatacatcaacaggtgaatagatttaa

SEQ ID NO: 1937 - DNA, 638 bp, Homo sapiens
ttaaacaaaataagatttcaaattcagtacaaactacataatccagtgatttctcaaagagcactctttgctagcttcttcctaaacaaaatctactctaggaagatggcccacctggatgatggttccaggagggccagctcccttattgctttgctttctcttcctcctcttctggtaccttggggaactgatcacaaagagccttttgagggtgatggaaagctacccctccattcctcaggcagttttccaaagatgacacttggctaaatgctcagggtatttacagtcataggagataaactatcaacttgttactgttaaaaaaatcttgagatctgggatcttgatgcctgaaaatcccaagattggtacttggcaaactgaaagaaatctagaaaaccctagagatcaggcatctgtggccagctaactggtcatacaaatggattgttgtggtgaacttgtatagtattaatcctgagatgctgtccccctccacccccacccccacaaaaaaaataaataaagtagtattaagttagcctcatacaaatgctggcaccatgctcctggacttctcagcctccataactgtgagccaaataaacttcctttctttataaattacccag

SEQ ID NO: 1938 - DNA, 330 bp, Homo sapiens
gttttactgcttgtttttgttttgttttgttttttgctgttgctggtggtgggggtgtgtgtgccagctcttccactgaagtatcttcaacacggttgttttttaaagttgtgaatacattttaggttgggcccatcataaaatataaaggacataaacttgagtttgaaacctttcattgaagatagagatgattataggattacacataaaacctaggtcttaaactgctctacctttagagagacgttttcaactgaacccttagagcagttaatatatggtttttaaaaaaacagacttttcttgtcatgagaatgaaacaacagt

SEQ ID NO: 1939 - DNA, 117 bp, Homo sapiens
gaggtgtggtttctctctgctggcttagttacaggtggtggcctgtctctccggggtctggctgtagccatgtccctgcacccaccttgccagccagggacaggccccatcaagacc

SEQ ID NO: 1940 - DNA, 448 bp, Homo sapiens
atccaaaagttttaatcaatgctatcttagcttttacctagccttttgttttgctatgtcattttgctttatccagtggggttttataagaactacctttatttaggacatagggagtatttaagtgctttttggagaaccatttttacctacttgttggctaagtagagaagactattaactcccagacaagtaagatcataaacatttgctgctcaaatatttttttttttttgagacggcgtctccctcagtcgcccaggctagagtgcagtggcgcgatctcggctcactgcaagctcggcctcctgggttcacgccattctcctgcctcagctacttgggaggctgaggcaggagaatcacttgaacctgggaggcggaggttgcagtaagctgagaccacgccactgcactccaacctggcaacagagtgagactccatttc

SEQ ID NO: 1941 - DNA, 506 bp, Homo sapiens
tctaaggtgacgtttatatttgtgtggaattttgttctaccatgtaagaatgtcaagcattttcctcgttaaaattatcagggacttatttcagtgaacataatgtcctctgccgtcatccattttgtcgcagtgatctcacttatatgtggaatccaaaaaagtcaaactcatagaagtagagagtagaatggtgattaccagaggctaaggtagatggagaaaggagaaacattggccaatgggtgcaaagttacagttagataggaggaataatttctgttttattgcacagtaaggtgattatagttcataataatgtatatttcaaaatagctaagagtattttaaatgttcttaccagaaagaagtgataagggcctggtgcagtggctcatgcctgtaatcccagcactctgggaggccgaagtgggtggaccacttgatgccagaagttcaagactagcctggccaacatgacaaaaccccatctcttctaaaaatac

SEQ ID NO: 1942 - DNA, 467 bp, Homo sapiens
tacaaatgtgcaaaatgttttgcaatatagaccaatagcctcaatcattgttacagaccttcctttttatccagaccatgctatccctaggtttctaagccagtattctaagatcaaactaaagccacatgagatacagaactgttcgagacaactcatcttagatagatgacggacaaaatattaattattccggcaagtgttaaggccccttacatttctcaataatgtaatcctcttgggagaaaaaaaatgtctgtgagagtttttaatatcgttgtaagggagagtaactgtacatagatctgaaaaggacaaattatatttagtaaatttgtctttagatttgtgttcagtttaaaacaagtttcctctcattcatcatcaaagccattaaataaatggcatcttgttcgactgtctttcctttgtaatatgctcacaggcaaacaaccagaaaaatcttc

SEQ ID NO: 1943 - DNA, 390 bp, Homo sapiens
  misc_feature (307)..(309): n is a, c, g, or t
ctggctcaacgtgtcagcagatggtgacaacgtgcatctggttctgaatgtctctgaggagcagcacttcggcctctccctgtactggaatcaggtccagggccccccaaaaccccggtggcacaaaaacctgactggaccgcagatcattaccttgaaccacacagacctggttccctgccagacttcctgggggccctgcagcagcctcgcgccccgcgttccgggcggctccaagagagagcggagcaagtgtcccgggcccttcagccagccctggatagctacttccatcccccggggatcnnncgccgggacgcggggtgggaccaggggcgggacctggggcgggggacgggacttaaataaaggcagacgctgtttttctaa

SEQ ID NO: 1944 - DNA, 516 bp, Homo sapiens
tgtatataattaaaaataagtatgactgcagccctgcctctgagctgctactctgggcccactgcctatggggtagccctgctctgcaaggaccaggacctctgctgctgctgtgtgtgccctgctgcctcaaaagttgctgcctagcactaccggctcctccttgaatttttttctgggcaaagccaagaactctcccaggctaaaccccaattttgaggctcgcttgccctgcatcgatttcattcctaataacttgccccttgcaacacacagagggccctgtgcagcatcaaaagggctacctttaattgaacatcagccaagactggaaggtaaatcatctatttttcccccatcaccatgatggcctcttttaacccttcccggggcaaagaatacaaaaccctgcatgtggctaaactaacagaggaaggcttcggaggtcccttattcttcaacccagtctcctaacagccattcaacatgttggcggggagggaaaaggaaaaaaaa

SEQ ID NO: 1945 - DNA, 393 bp, Homo sapiens
tttaatcaagaatctttaatagttttccaaaagcttcagggcttgtctttaagtaggcactgcactctgtaaccctatgttcatccacatgtagcccctttgaaggactttacctccaacaaaaccctgctatttttaaaggttcagttgtgtcatctcatctgtgaaagatgtcatcatctctttctctcatccttgtcccttccccactttggaaaagtaatcaccacctccttctcataacacttggtttcccattgccagtataagctatactatggagttgagggactccacaaagttccattaatacataactgtgttgaaggcaagaaaatgaaagctcttgggagaattaaaaagtaatatgttcacttggggttttttccccct

SEQ ID NO: 1946 - DNA, 667 bp, Homo sapiens
acaggcccttggagctgtctgttttactacttttgcttacattctattaatattgagccccatggaacctcagtttattcatctgtaaaatgtggtagtgcgcagggcttctacttcacaaactctggggctgcaatgaaaagggagtccaggccgggtgcagtggctcatgcctgtaatcccaacactttgggaggccaagacgggcagatcacttgaggtcaggagttcaagaccagcctggccaacatggtgaaaccccatctctactaaaaatacaaaaaaattagccgggcatcatggcacgtatctgtaatcccagttactcaggaggctgaggaataacttgaacccaggaggcggaggtggcagtgagccgagatcgcacctctgcactcaagcctgggtgatggagcaagactcttatctcaaaaaaaataaataaataagggggagtctagccaggtgacctcagtcaacagtagtttgttcaagaaaccttgagaagaaagaaagagagcaagaagaacaaggatgccacctggctccatctaggatatcatgatgactctagtgaccacaaagcaattccccattctattatgttgttgaccctgcctgtgaccttgaccctgcctatgacctattccttctaatgtgccagtaa

SEQ ID NO: 1947 - DNA, 409 bp, Homo sapiens
aatctctatttgtaagagtgtctccctttctggggaagagaaggatgaccaaattgcaagagactcctatcaacagagataacaacataaatctgcaaaacaatcgtttctcttatttaccatgctttttgtggtaaccttccttcacatcctttcgagttgaagttgctatgtaagctggagttttaggctccctcttggagagtttttatttctccctggataatcttctgtgtatacatgaggtatacatgttaataaactgtttttctcttgttggtctgtcttgttggagcagtcccagctaagaactcagaaaggtaaagggaaaattcccccaccacacacaatgaataatagaaaattaagttttaaagtgtattttagaaagagcatgttgtcatgacta

SEQ ID NO: 1948 - DNA, 484 bp, Homo sapiens
gcagaagagatagtgctgtcagtttaatccaagtgcagagaaggagttgcaggtgtatccctcaactcaaaaccaagcagaggccctgggtggagagggaacacagtgaatagagatgccatcgagctctacaggacaagccactgtgattttgcagtaactcttgtcctccaggtcagggatcctttttgtgaccacaagaaagatttcttccctggtgtttgggaggtgtaagcgaagtcaggatgcctggatttgccatcacagaggaatgcaaagaatgatagtaaagtttttcatttcacaagagagacttttggtcttctatttttgatatgaaaatagtaatttgaaaataccctttcctttgctgtgctttctgtcaaatttggtaccaccacgacctgatgaactttacttggcaggctgccaaactaaatacatcttggccaagtgcctaataataatgatggctaacgtggtg

SEQ ID NO: 1949 - DNA, 505 bp, Homo sapiens
ttgagcctcaaagggattaggcaaattgtccatggtctcaccagagtgtgtagtgtggcccaccactctcagttttactcagctgtaaattttgtgctccttcttttttcacactgtaaacaacctgtttgcagcctgtttacactagaatagttgtcttgaaccaggtggcagtgagtggtttcatacccagctccattcttgagtctggagttttctgtgatccattttagaggattggtccagatgggacagcccataggtgctgactggggcgctgccccaccccttggtaccaagatcttccaggggagtctagaggctgtacaggggaagttcctggtctgggatgtggagggcttcatctcactgaaaaatcagccatttctgacttgatttccttccctgcctttctctgttagaggagtgctagcatgtttagcccttgctggtctttcacctgagggtacagctgagtagttcacacagcatggcctccctcaca

SEQ ID NO: 1950 - DNA, 166 bp, Homo sapiens
actgatttgtacactttaaaaaggccagttttatggtatgtgaattacatctcagtgcaactgttgtaaaattaaaagaacaaaagaatatctgaaatgctgtgaacagatgaaataaacttcaactggcccaaaatgctatattccagtaagcattactagaccc

SEQ ID NO: 1951 - DNA, 589 bp, Homo sapiens
gggagaaaaatcttttccagaatcttccctgccacaggaacccccgcgtgtctcttagaacaggattgggtcacacagactggttgcaaaatggaatttttagctttttccgctcctctggtaggaggtggacaaggaagaagaagttggaagtggttttcggatgggcattcatcagcattggttaccaggttcacaaaaataaaacacaggctgcaaactgaagagaaccatacagcgagtgttaagttgccatcgcttagtagctagaaatactgcagaatgtcccctcctttgatttccagtgtcatgtggtaattttggttcattctgtttcacataattttaccagctctctaccgaatcttaaattactttttttaatgttatggctagtttctaggaccccactatagttctggattaactcagatgcttgaggggaaaaaaaaaaaagttaaccaaaaaatccacggccagcacggtggcttacgcctgtaatcccagcactttgggaaggcaaggggtggatcacctgaggtcaggagttcgacaccagcctgttcaacatggagaaaccccgtctcta

SEQ ID NO: 1952 - DNA, 2040 bp, Homo sapiens
ggcttctctctgggtttgtggaatttggttctgctgtggtgtatgtatacaggtcagctgctcccccaagccttcaaagcaaggttcccacgcatctttccatgaagtctgtaccaccctttttggtaaaagatccagccacaaaatggatgattttataagccaaaatttgaatactggcaattattcaagtagcccaggctcagccacgtgccgtctgcgtccgtgggctacacacaccccctcttttctcactgcctcctgggcggtgtggatcagctgcagagtgtgatctgcggtcagggagtgccttcccggagttttcgctttcagacccctggtgttaaagacgttctgtgagcgggtggggccgggcgccccagtcacggcggccgccgcctcctcttcccgcaggacgggacagcgcccctgtggatcgcgtcccagatgggccacagcgaggtggtgcgggtgatgctgctgcgcggagccgaccgcgacgctgcgcggaacgatggcacaacagcattattgaaagcagccaacaaagggtataatgatgtcataaaagagttgcttaaattctcacccactcttggtattttgaagaatgggacatcagcgctccatgcagcagtgctcagtggaaacattaaaacagttgcgctgctcctagaagcaggggcagacccatccctgagaaacaaggtgcgatggcagaactgattgggccagattactggtctgggtggtgtcgctgatccatcaagtgcaaggccaatgaacttccggcagaactaaccaaaaatgaacgtatattgcgtctcctgagaagtaaagaaggtcccagaaagagctaacttagctccatatttgacagaaagatagaaagcttaaccacattgtccaaaaagaaattgcatttcaagcagtgttggaaattcttttatgaaaaaaaaagatgcccagaatgcccatcctgtgggtccctgacaaagaagagctacgctctgtgcacgaagtcaagaaccaaacagctcagggaccctcttgccccttcaccatggacttctcatggtgtcctgtaactcatctcccggggggcctggcatgttcacagattccacagaaactcattttcaacaatgctaacttggacctgtcagttaaactctaaggtggacagggttctcagtactaagcaaggagacagaatgctttgttcctttaaaagactgaaaagctgaccttcaatggattgaggcacttttgcttttgtgttaaatgtagatgtgctaaaatatatagatctatcatattttacctacatatgtatgtcattccagtataaaacattctcctctacccaagaaccatagccatgattgttataaatcaatgaagtgtaaacatacattattaaaaaaccacttctgacattccattatgtgctattcaaagatggactattgaactatagaaaagacagactgtgcatttgttcgttgatcctcatcttattcctgacatgtaaaaatcaattttacgtagagtcaacattgtaggtaggttaaaataccagtggcaaatttggaaattcagaaacttataaaccacgagaaatatataggcttgtctctttggtcttttattttggctctattgttgggaatctatttcctattccataagtaagtatacctaacatgctgtggaatcttgagtttccaacaccgtgctgcttgatagaatgactttgaggtccttggataaaatgtgatatatgcaagtacagtatgttgctattactattgcaggaatataaataataaaagactgttattagcacttagtaagtcttcatctatgcatgtttttgagttgactgattccaagaatgaaatatgaggtttattgaattattcctttgaaagggatcaaaacttatattcaatgcactttataattaatggtgtctaaatgcctcagtcagtgcctaactgcacatacaaaaataaaaccttctttctgtaatctacc

SEQ ID NO: 1953 - DNA, 964 bp, Homo sapiens
gagcgggtgcggcggctgctgccgggccgggcggcgggagcgcgcggcgtcggaggccgcccctctgcggaacgccgagagccccgggagagtgaagggccggggaggacaaggcgccccgggcccaaagcgcgccggctcccgctcgggcggccgcggacatgtgcaggatgtccttcaagaaggaaactccacttgccaatgctgcattctgggcagccaggagaggaaacctggcgctgctgaagctgctgttgaacagcggccgggtggacgtggactgcagagacagcgtacggtggttcggtagatgcatgcccagcatgcaccattgccctctgtgggcacaggagcacctcaggaatacattcccctttacaatgcttatttactttttcatgtgtttgcttgctttatcctttttaaaacatccaaggtactgtggtgaacttaaaaacatgctgggggaagtcagaaagaaaaggaaacaatgaaatgcataaaacagaaggcaaccacaatagggaaagaggcacttcactgggaatcagaattggcagattacaagaagaaaagcctgtttagtgaaagaattcaagccaaccacttccatgaaaagatggagataatttagagcacaagtgggctgccatggatgtgggcgttatgtttcttctacaaggatgagaaaacaaaaattgaagcctcccccaggattttatcctttcattacctcttgaaaacataaatacactaattggcaatttaaaaagggaaacaaaaatagatactactgcccactggcagataccacttagagagcttttccatccccagctagaggcaatcgtttttctgtcctcagcaagacttctcatctctgggaccaagaggacctccaatgaggaaagggagcgagcaatgatgttttgattttaggatttgaataaaaatgtttcaaagg

SEQ ID NO: 1954 - DNA, 2316 bp, Homo sapiens
gagcgggtgcggcggctgctgccgggccgggcggcgggagcgcgcggcgtcggaggccgcccctctgcggaacgccgagagccccgggagagtgaagggccggggaggacaaggcgccccgggcccaaagcgcgccggctcccgctcgggcggccgcggacatgtgcaggatgtccttcaagaaggaaactccacttgccaatgctgcattctgggcagccaggagaggaaacctggcgctgctgaagctgctgttgaacagcggccgggtggacgtggactgcagagacagccatggcaccacactcctgatggttgctgcctacgctggccacatagactgtgtgagggaactggttctgcaaggagcagacatcaatctccagagagagtcaggtacaactgccctattctttgccgcccagcaaggccataatgatgtcgtgagatttctctttggatttggagcatccactgaatttaggaccaaagacgggggcaccgccctgtttggctgccagtcagtacgggcacatgcaggtggtggagaccttgctgaagcacggagcaaacatccatgaccaactttatgatggagccactgccctcttcctagctgcccaaggtggttacttggatgttattcgattactgctggcttcaggagcaaaagtcaaccagccaaggcaggacgggacagcgcccctgtggatcgcgtcccagatgggccacagcgaggtggtgcgggtgatgctgctgcgcggagccgaccgcgacgctgcgcggaacgatggcacaacagcattattgaaagcagccaacaaagggtataatgatgtcataaaagagttgcttaaattctcacccactcttggtattttgaagaatgggacatcagcgctccatgcagcagtgctcagtggaaacattaaaacagttgcgctgctcctagaagcaggggcagacccatccctgagaaacaaggtgcgatggcagaactgattgggccagattactggtctgggtggtgtcgctgatccatcaagtgcaaggccaatgaacttccggcagaactaaccaaaaatgaacgtatattgcgtctcctgagaagtaaagaaggtcccagaaagagctaacttagctccatatttgacagaaagatagaaagcttaaccacattgtccaaaaagaaattgcatttcaagcagtgttggaaattcttttatgaaaaaaaaagatgcccagaatgcccatcctgtgggtccctgacaaagaagagctacgctctgtgcacgaagtcaagaaccaaacagctcagggaccctcttgccccttcaccatggacttctcatggtgtcctgtaactcatctcccggggggcctggcatgttcacagattccacagaaactcattttcaacaatgctaacttggacctgtcagttaaactctaaggtggacagggttctcagtactaagcaaggagacagaatgctttgttcctttaaaagactgaaaagctgaccttcaatggattgaggcacttttgcttttgtgttaaatgtagatgtgctaaaatatatagatctatcatattttacctacatatgtatgtcattccagtataaaacattctcctctacccaagaaccatagccatgattgttataaatcaatgaagtgtaaacatacattattaaaaaaccacttctgacattccattatgtgctattcaaagatggactattgaactatagaaaagacagactgtgcatttgttcgttgatcctcatcttattcctgacatgtaaaaatcaattttacgtagagtcaacattgtaggtaggttaaaataccagtggcaaatttggaaattcagaaacttataaaccacgagaaatatataggcttgtctctttggtcttttattttggctctattgttgggaatctatttcctattccataagtaagtatacctaacatgctgtggaatcttgagtttccaacaccgtgctgcttgatagaatgactttgaggtccttggataaaatgtgatatatgcaagtacagtatgttgctattactattgcaggaatataaataataaaagactgttattagcacttagtaagtcttcatctatgcatgtttttgagttgactgattccaagaatgaaatatgaggtttattgaattattcctttgaaagggatcaaaacttatattcaatgcactttataattaatggtgtctaaatgcctcagtcagtgcctaactgcacatacaaaaataaaaccttctttctgtaatctacc

SEQ ID NO: 1955 - DNA, 2384 bp, Homo sapiens
gagcgggtgcggcggctgctgccgggccgggcggcgggagcgcgcggcgtcggaggccgcccctctgcggaacgccgagagccccgggagagtgaagggccggggaggacaaggcgccccgggcccaaagcgcgccggctcccgctcgggcggccgcggacatgtgcaggatgtccttcaagaaggaaactccacttgccaatgctgcattctgggcagccaggagaggaaacctggcgctgctgaagctgctgttgaacagcggccgggtggacgtggactgcagagacagccatggcaccacactcctgatggttgctgcctacgctggccacatagactgtgtgagggaactggttctgcaaggagcagacatcaatctccagagagagtcaggtacaactgccctattctttgccgcccagcaaggccataatgatgtcgtgagatttctctttggatttggagcatccactgaatttaggaccaaagacgggggcaccgccctgtttggctgccagtcagtacgggcacatgcaggtggtggagaccttgctgaagcacggagcaaacatccatgaccaactttatgatggagccactgccctcttcctagctgcccaaggtggttacttggatgttattcgattactgctggcttcaggagcaaaagtcaaccagccaaggcaggacgggacagcgcccctgtggatcgcgtcccagatgggccacagcgaggtggtgcgggtgatgctgctgcgcggagccgaccgcgacgctgcgcggaacgtgagtgcccgagtcgcgcggccaaagagcgaagcctcccggcgcgcctgtgtggagaaaacgggtcttgactgagtctgcagcccacatgggtttcctcccaacctccttccttgagcaggaaaacaaagtcaaggatggcacaacagcattattgaaagcagccaacaaagggtataatgatgtcataaaagagttgcttaaattctcacccactcttggtattttgaagaatgggacatcagcgctccatgcagcagtgctcagtggaaacattaaaacagttgcgctgctcctagaagcaggggcagacccatccctgagaaacaaggccaatgaacttccggcagaactaaccaaaaatgaacgtatattgcgtctcctgagaagtaaagaaggtcccagaaagagctaacttagctccatatttgacagaaagatagaaagcttaaccacattgtccaaaaagaaattgcatttcaagcagtgttggaaattcttttatgaaaaaaaaagatgcccagaatgcccatcctgtgggtccctgacaaagaagagctacgctctgtgcacgaagtcaagaaccaaacagctcagggaccctcttgccccttcaccatggacttctcatggtgtcctgtaactcatctcccggggggcctggcatgttcacagattccacagaaactcattttcaacaatgctaacttggacctgtcagttaaactctaaggtggacagggttctcagtactaagcaaggagacagaatgctttgttcctttaaaagactgaaaagctgaccttcaatggattgaggcacttttgcttttgtgttaaatgtagatgtgctaaaatatatagatctatcatattttacctacatatgtatgtcattccagtataaaacattctcctctacccaagaaccatagccatgattgttataaatcaatgaagtgtaaacatacattattaaaaaaccacttctgacattccattatgtgctattcaaagatggactattgaactatagaaaagacagactgtgcatttgttcgttgatcctcatcttattcctgacatgtaaaaatcaattttacgtagagtcaacattgtaggtaggttaaaataccagtggcaaatttggaaattcagaaacttataaaccacgagaaatatataggcttgtctctttggtcttttattttggctctattgttgggaatctatttcctattccataagtaagtatacctaacatgctgtggaatcttgagtttccaacaccgtgctgcttgatagaatgactttgaggtccttggataaaatgtgatatatgcaagtacagtatgttgctattactattgcaggaatataaataataaaagactgttattagcacttagtaagtcttcatctatgcatgtttttgagttgactgattccaagaatgaaatatgaggtttattgaattattcctttgaaagggatcaaaacttatattcaatgcactttataattaatggtgtctaaatgcctcagtcagtgcctaactgcacatacaaaaataaaaccttctttctgtaatctacc

SEQ ID NO: 1956 - DNA, 2353 bp, Homo sapiens
gagcgggtgcggcggctgctgccgggccgggcggcgggagcgcgcggcgtcggaggccgcccctctgcggaacgccgagagccccgggagagtgaagggccggggaggacaaggcgccccgggcccaaagcgcgccggctcccgctcgggcggccgcggacatgtgcaggatgtccttcaagaaggaaactccacttgccaatgctgcattctgggcagccaggagaggaaacctggcgctgctgaagctgctgttgaacagcggccgggtggacgtggactgcagagacagccatggcaccacactcctgatggttgctgcctacgctggccacatagactgtgtgagggaactggttctgcaaggagcagacatcaatctccagagagaggacgggggcaccgccctgtttggctgccagtcagtacgggcacatgcaggtggtggagaccttgctgaagcacggagcaaacatccatgaccaactttatgatggagccactgccctcttcctagctgcccaaggtggttacttggatgttattcgattactgctggcttcaggagcaaaagtcaaccagccaaggcaggacgggacagcgcccctgtggatcgcgtcccagatgggccacagcgaggtggtgcgggtgatgctgctgcgcggagccgaccgcgacgctgcgcggaacgtgagtgcccgagtcgcgcggccaaagagcgaagcctcccggcgcgcctgtgtggagaaaacgggtcttgactgagtctgcagcccacatgggtttcctcccaacctccttccttgagcaggaaaacaaagtcaaggatggcacaacagcattattgaaagcagccaacaaagggtataatgatgtcataaaagagttgcttaaattctcacccactcttggtattttgaagaatgggacatcagcgctccatgcagcagtgctcagtggaaacattaaaacagttgcgctgctcctagaagcaggggcagacccatccctgagaaacaaggtgcgatggcagaactgattgggccagattactggtctgggtggtgtcgctgatccatcaagtgcaaggccaatgaacttccggcagaactaaccaaaaatgaacgtatattgcgtctcctgagaagtaaagaaggtcccagaaagagctaacttagctccatatttgacagaaagatagaaagcttaaccacattgtccaaaaagaaattgcatttcaagcagtgttggaaattcttttatgaaaaaaaaagatgcccagaatgcccatcctgtgggtccctgacaaagaagagctacgctctgtgcacgaagtcaagaaccaaacagctcagggaccctcttgccccttcaccatggacttctcatggtgtcctgtaactcatctcccggggggcctggcatgttcacagattccacagaaactcattttcaacaatgctaacttggacctgtcagttaaactctaaggtggacagggttctcagtactaagcaaggagacagaatgctttgttcctttaaaagactgaaaagctgaccttcaatggattgaggcacttttgcttttgtgttaaatgtagatgtgctaaaatatatagatctatcatattttacctacatatgtatgtcattccagtataaaacattctcctctacccaagaaccatagccatgattgttataaatcaatgaagtgtaaacatacattattaaaaaaccacttctgacattccattatgtgctattcaaagatggactattgaactatagaaaagacagactgtgcatttgttcgttgatcctcatcttattcctgacatgtaaaaatcaattttacgtagagtcaacattgtaggtaggttaaaataccagtggcaaatttggaaattcagaaacttataaaccacgagaaatatataggcttgtctctttggtcttttattttggctctattgttgggaatctatttcctattccataagtaagtatacctaacatgctgtggaatcttgagtttccaacaccgtgctgcttgatagaatgactttgaggtccttggataaaatgtgatatatgcaagtacagtatgttgctattactattgcaggaatataaataataaaagactgttattagcacttagtaagtcttcatctatgcatgtttttgagttgactgattccaagaatgaaatatgaggtttattgaattattcctttgaaagggatcaaaacttatattcaatgcactttataattaatggtgtctaaatgcctcagtcagtgcctaactgcacatacaaaaataaaaccttctttctgtaatctacc

SEQ ID NO: 1957 - DNA, 1972 bp, Homo sapiens
ggcttctctctgggtttgtggaatttggttctgctgtggtgtatgtatacaggtcagctgctcccccaagccttcaaagcaaggttcccacgcatctttccatgaagtctgtaccaccctttttggtaaaagatccagccacaaaatggatgattttataagccaaaatttgaatactggcaattattcaagtagcccaggctcagccacgtgccgtctgcgtccgtgggctacacacaccccctcttttctcactgcctcctgggcggtgtggatcagctgcagagtgtgatctgcggtcagggagtgccttcccggagttttcgctttcagacccctggtgttaaagacgttctgtgagcgggtggggccgggcgccccagtcacggcggccgccgcctcctcttcccgcaggacgggacagcgcccctgtggatcgcgtcccagatgggccacagcgaggtggtgcgggtgatgctgctgcgcggagccgaccgcgacgctgcgcggaacgatggcacaacagcattattgaaagcagccaacaaagggtataatgatgtcataaaagagttgcttaaattctcacccactcttggtattttgaagaatgggacatcagcgctccatgcagcagtgctcagtggaaacattaaaacagttgcgctgctcctagaagcaggggcagacccatccctgagaaacaaggccaatgaacttccggcagaactaaccaaaaatgaacgtatattgcgtctcctgagaagtaaagaaggtcccagaaagagctaacttagctccatatttgacagaaagatagaaagcttaaccacattgtccaaaaagaaattgcatttcaagcagtgttggaaattcttttatgaaaaaaaaagatgcccagaatgcccatcctgtgggtccctgacaaagaagagctacgctctgtgcacgaagtcaagaaccaaacagctcagggaccctcttgccccttcaccatggacttctcatggtgtcctgtaactcatctcccggggggcctggcatgttcacagattccacagaaactcattttcaacaatgctaacttggacctgtcagttaaactctaaggtggacagggttctcagtactaagcaaggagacagaatgctttgttcctttaaaagactgaaaagctgaccttcaatggattgaggcacttttgcttttgtgttaaatgtagatgtgctaaaatatatagatctatcatattttacctacatatgtatgtcattccagtataaaacattctcctctacccaagaaccatagccatgattgttataaatcaatgaagtgtaaacatacattattaaaaaaccacttctgacattccattatgtgctattcaaagatggactattgaactatagaaaagacagactgtgcatttgttcgttgatcctcatcttattcctgacatgtaaaaatcaattttacgtagagtcaacattgtaggtaggttaaaataccagtggcaaatttggaaattcagaaacttataaaccacgagaaatatataggcttgtctctttggtcttttattttggctctattgttgggaatctatttcctattccataagtaagtatacctaacatgctgtggaatcttgagtttccaacaccgtgctgcttgatagaatgactttgaggtccttggataaaatgtgatatatgcaagtacagtatgttgctattactattgcaggaatataaataataaaagactgttattagcacttagtaagtcttcatctatgcatgtttttgagttgactgattccaagaatgaaatatgaggtttattgaattattcctttgaaagggatcaaaacttatattcaatgcactttataattaatggtgtctaaatgcctcagtcagtgcctaactgcacatacaaaaataaaaccttctttctgtaatctacc

SEQ ID NO: 1958 - DNA, 2176 bp, Homo sapiens
ggcttctctctgggtttgtggaatttggttctgctgtggtgtatgtatacaggtcagctgctcccccaagccttcaaagcaaggttcccacgcatctttccatgaagtctgtaccaccctttttggtaaaagatccagccacaaaatggatgattttataagccaaaatttgaatactggcaattattcaagtagcccaggctcagccacgtgccgtctgcgtccgtgggctacacacaccccctcttttctcactgcctcctgggcggtgtggatcagctgcagagtgtgatctgcggtcagggagtgccttcccggagttttcgctttcagacccctggtgttaaagacgttctgtgagcgggtggggccgggcgccccagtcacggcggccgccgcctcctcttcccgcaggacgggacagcgcccctgtggatcgcgtcccagatgggccacagcgaggtggtgcgggtgatgctgctgcgcggagccgaccgcgacgctgcgcggaacgtgagtgcccgagtcgcgcggccaaagagcgaagcctcccggcgcgcctgtgtggagaaaacgggtcttgactgagtctgcagcccacatgggtttcctcccaacctccttccttgagcaggaaaacaaagtcaaggatggcacaacagcattattgaaagcagccaacaaagggtataatgatgtcataaaagagttgcttaaattctcacccactcttggtattttgaagaatgggacatcagcgctccatgcagcagtgctcagtggaaacattaaaacagttgcgctgctcctagaagcaggggcagacccatccctgagaaacaaggtgcgatggcagaactgattgggccagattactggtctgggtggtgtcgctgatccatcaagtgcaaggccaatgaacttccggcagaactaaccaaaaatgaacgtatattgcgtctcctgagaagtaaagaaggtcccagaaagagctaacttagctccatatttgacagaaagatagaaagcttaaccacattgtccaaaaagaaattgcatttcaagcagtgttggaaattcttttatgaaaaaaaaagatgcccagaatgcccatcctgtgggtccctgacaaagaagagctacgctctgtgcacgaagtcaagaaccaaacagctcagggaccctcttgccccttcaccatggacttctcatggtgtcctgtaactcatctcccggggggcctggcatgttcacagattccacagaaactcattttcaacaatgctaacttggacctgtcagttaaactctaaggtggacagggttctcagtactaagcaaggagacagaatgctttgttcctttaaaagactgaaaagctgaccttcaatggattgaggcacttttgcttttgtgttaaatgtagatgtgctaaaatatatagatctatcatattttacctacatatgtatgtcattccagtataaaacattctcctctacccaagaaccatagccatgattgttataaatcaatgaagtgtaaacatacattattaaaaaaccacttctgacattccattatgtgctattcaaagatggactattgaactatagaaaagacagactgtgcatttgttcgttgatcctcatcttattcctgacatgtaaaaatcaattttacgtagagtcaacattgtaggtaggttaaaataccagtggcaaatttggaaattcagaaacttataaaccacgagaaatatataggcttgtctctttggtcttttattttggctctattgttgggaatctatttcctattccataagtaagtatacctaacatgctgtggaatcttgagtttccaacaccgtgctgcttgatagaatgactttgaggtccttggataaaatgtgatatatgcaagtacagtatgttgctattactattgcaggaatataaataataaaagactgttattagcacttagtaagtcttcatctatgcatgtttttgagttgactgattccaagaatgaaatatgaggtttattgaattattcctttgaaagggatcaaaacttatattcaatgcactttataattaatggtgtctaaatgcctcagtcagtgcctaactgcacatacaaaaataaaaccttctttctgtaatctacc

SEQ ID NO: 1959 - DNA, 968 bp, Homo sapiens
agactcaggaggctcagtgggtgagaaaatgcaaagtggcttcacagacacagggctgtgggagcagatcgacggggaacttgggagatgaacttcagggccttccgacgccttgtctcaggaacatgctttgagaaaaatggtagcatcctttccataactcagtctctcttccctagtttccctgaagtgtgacgttttagtatctggagctcagtgatccccatgaatgagggataaagtttcactcttggtattttctaactagtgctagggaaagtcctgagacacgatcacagccactgcttggcatacagggcctccacccaataagcaaactggagattcctcagcctctcgtggacacccacatctcattcttctcacagcagagaagctctcccttcagcctgagctgtcttctttctgctgcagtgcagcctgctccctcctaccctggcctcaaggaaggtgggaaacatcttctgcatttcaaagtcctcactttgacttatttggccttcatcttggcatggaaggtggcaggcagaatggaaatactccccccaaacaaaacagatattcttgcgtgtgtaagggcagaagggacaagctctctatcccatgagactaggggccggagcccacctgcctttccccacaacttttcctgctcaaacccactcctcttgacacactggaatctgtattatatatatttttaagaaaatacaatgatggttgtctggttttgttgtttttacaggtgttgtggaataaaaactgtaagaaaattaagtatttaaaatgttccaataaagtggggttttttgttattctaatatattattgtgtacctattgtaaatatgaaacactcctattttgcaagctgaggacacaatttgtactgttgttatatataaataaagtttactgaattaaaaaaaccttaaatctttaaataaa

SEQ ID NO: 1960 - DNA, 294 bp, Homo sapiens
gactagtgaagcattaacagaaatataatgtgcataaagcatttaagaagtcaaattaacttgatttaacttgacattctcagtcatttaagaaaaagtgttcatcccaaaatacactcgtaaatgtgactagcaaagagacctatttctatcaactcaactgtgttacagtcggatacaacttttactacaaaacatgtaaactggatacagtttccaaaggaatcacgttccacctacaggggaatttagctttaaaagtacagaatgaatgtttaataaatgccccataat

SEQ ID NO: 1961 - DNA, 258 bp, Homo sapiens
acagaggattaagcataatagaagtgtcttgctctcatgttaaaggagtgtaaaggtggacagcctagggatgtatgtcagtgatatggtagagtgaaggatgtttttatctttctgctccatcattctaatgcatggcctccacagttaaggttgctttatggttcaaaatatttattggatttccactgatcacactttatggcaggcaaaaaagggagagcagggggagcagaagggtacaaatgagccccttcc

SEQ ID NO: 1962 - DNA, 1158 bp, Homo sapiens
acagtctccactgaaaggctaaatgggaggatcttcccccgtgacctcaaaagctattgtggatgctgatggaagaatttatattcggaactggcagggtggcatcctgtctgggggctttgagaagaacccgaaaccaattttcactgagggcaagaaccagctggagattcagaatctacaggaagactgggatcactttgagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaccttgccgaatggatggtacatggttatccctcagaaaacgtttgggaattggacctgaaacgttttggagccctccagagcagccgcacctttctgcgccaccgggtcatggaagtcatgcctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaaggacctcctggcattggagcagagcaagactttctataagccagattggtttgacatcgtggagtctgaagtcaagtgctgtaaggaagctgtgtgtgtcattgacatgtcctctttcacaaagtttgagataacagtaagtatttgggaaccaaaaagtaatagattaggaaactttacatatttattgaatgccttttgtttttcatcttcaaaactgattcctgactgggtgcagtgggtcatgcctgtattcccagcactttgggaggccaagggggcgtggatcacctgaggtcagagttccagaccagcctggccaagatggtgaaaccccgtttctactaaaaatacaaaaattaaggccaggagtggtggctcatgcctgtaatcccagcagtttgggaggccgagacgggtggatcacctgagatcaggagttcaagaccagcctggccaacatggcgaaaccgtctctaccaa

SEQ ID NO: 1963 - DNA, 595 bp, Homo sapiens
ctgagtccaggcgttttatcaaaaggacctcctttggttcccatgagctcctttgactagctggtaaatatctcttcctttgatctcaaagtaatttttatgtcttaaaaaatgtagtattgctccccatccaaataattgaactaaagcaggctgacttcccacacctgacactgtagcaagagcacacataagccacttggaattaatctcaagaggctgaacttgctcatttttatttctgttcctcttcccacccacaaatcaacctgtccatttgtagtgggcatacgagctgggtctgtccaacgaggagccggttagtatcccgctacatgcctgcgaacacttctacctcctgactcgccccttggagacccctctgcagagcagcacaccaagtgaggacttgcacttttttaaaaaatcttgtttctttgccagtatcctgtcctctgaaaaggaaaactttctgctaaggacagcctgtgtctgaaagagtctttcatttctagagcatgttacagggaggtggacccaattctgacttttctttattaactctttatgaaaggatggccaaaatttccattaa

SEQ ID NO: 1964 - DNA, 596 bp, Homo sapiens
aagtgctaacctgctcataccatggatatgataccctggacactagttaagtcttcccctcattcaatgcaactgggctcatgatttcaggtgtggattaaacttccaaggtgtgttttcaccttgagcttctcaagtcctgtggcggaaaatattaccttaagtccaaagggcattaattggccgggcatggtggtgcatgcctgtaatcccagctacttgagaggctgaggcaggagaattgcttgaacccaggaggcagagagcgagccaagatcgcacgactacactccacccttggcgacaaagcaagactccatctcaaaaataaaataaaaaaataaattaaagcattgacttgactttgtcagtgtttcttctgggtggagaacctgctgcacatgccttcattctggaacatcagatgaaacaccaactctttctttaccttggaacaggtgttcagatctatgaccggacatctgttcttcatgtaatggtcaaaaaaggtcaagttactggagtggagaccgataaaggacagattgaatgccagtattttgtcaactgtgctggccaggtaggtcagcaccaac

SEQ ID NO: 1965 - DNA, 403 bp, Homo sapiens
gggctcatttttcttacaggttacacaaggacaggctcaatctttctggcccaaactcaggaccgactgatctccctgaagcgcatcaacgcagggctgaatgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgttcagatctatgaccggacatctgttcttcatgtaatggtcaaaaaaggtcaagttactggagtggagaccgataaaggacagattgaatgccagtattttgtcaactgtgctggccaggtaggtcagcaccaac

SEQ ID NO: 1966 - DNA, 1570 bp, Homo sapiens
gggctcatttttcttacaggttacacaaggacaggctcaatctttctggcccaaactcaggaccgactgatctccctgaagcgcatcaacgcagggctgaatgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatgtgggcatacgagctgggtctgtccaacgaggagccggttagtatcccgctacatgcctgcgaacacttctacctcctgactcgccccttggagacccctctgcagagcagcacaccaactattgtggatgctgatggaagaatttatattcggaactggcagggtggcatcctgtctgggggctttgagaagaacccgaaaccaattttcactgagggcaagaaccagctggagattcagaatctacaggaagactgggatcactttgagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaccttgccgaatggatggtacatggttatccctcagaaaacgtttgggaattggacctgaaacgttttggagccctccagagcagccgcacctttctgcgccaccgggtcatggaagtcatgcctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaagggctagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacaaagtttgagataacagtaagtatttgggaaccaaaaagtaatagattaggaaactttacatatttattgaatgccttttgtttttcatcttcaaaactgattcctgactgggtgcagtgggtcatgcctgtattcccagcactttgggaggccaagggggcgtggatcacctgaggtcagagttccagaccagcctggccaagatggtgaaaccccgtttctactaaaaatacaaaaattaaggccaggagtggtggctcatgcctgtaatcccagcagtttgggaggccgagacgggtggatcacctgagatcaggagttcaagaccagcctggccaacatggcgaaaccgtctctaccaa

SEQ ID NO: 1967 - DNA, 387 bp, Homo sapiens
ttcaagtgattctcccacctcaggctcccaagcagctgggactacagacatgtgccaccacgcccagctaatttcttgtgtttttaatagagatggggtttcaccatgttggccagtctggttttgaactcctgacctcaagtgatccatctaccttggcctcccaaaatgctgggattacaggcgtgagccaccatgcctgtccctatatattttctttttataatgcatagacataatagttgtcttgtaagtttttgtactgggttggagaagagtaaaataattttaagaaggtattttactattaatattgttggtgtggcagattggaagtatgatatatagactctggttactctacgtaggatagaagctacaatcttc

SEQ ID NO: 1968 - DNA, 471 bp, Homo sapiens
caatgcatgctcacagtccaagggagagggaaagctgtctaacaggattggttttcccgtgtgctttataagcagatgagtagaggagacagctcttattgtcctagtggcaattgggataggctgcaaagtttgttagggtggaggcttattccgggaccaagggagcccaaagaaacaagctcctgccaggcgcggtggctcacgcctgtaatcccagcactttgggaggctgaggcaggtggatcacctgaggtcaggagtttgagaccagcctggccaacatggtgaaaccccgtctccatgaaaaatacaaaaattacccgggcatggtggcgggcacctgtaatcccagctactagggaggctgaggcaggaaaatggcttgaacctcggaagtggaggtggccgttagccgagatcacgccactgcactccagcctgggcaacagagcaagactctgccttaaa

SEQ ID NO: 1969 - DNA, 343 bp, Homo sapiens
gtttgagaccaggctggccaatatggtgaaacccagtatctactaaaaacaaaaacaaaaatcagctgggtatggtggcacatgcccgtgtcccaggtactcaggaggctgaagcaggagaatcgcttgaacccaggaagcagaggtggcagtgagctaagatggcaccattgcattccagcctgggtgacagagcaagactccatctcaaaaaaaaaaaaaaaaaaaaaaaaagtggccgggagctgaagagcagctccaggagaggctcaggagggccaggcacaacccaggttcaccttgcaaaactgctctggttatgtttcttgtttctttttctttt

SEQ ID NO: 1970 - DNA, 380 bp, Homo sapiens
cttcttccttttcttgggtgtatttttttttcctgactctaatcaacagagataaatatcactataaagacttccttttctggccaagtatagtggccaatgcctataatcccagcactttgggaggccaaggcagaagaatcacttgagcccaggagatcaagaccagcctgggcaacataggaagaccctgtctctacaaaaataataataaattagccaggcatggtgggtgcacgctggtggtcccagctactcaggaggctgaggtaggaggatccgtctgagcctgggagatggaggctgcagtgagccctgattataccactgcaacgccagcgtgggtaagagaattagaccctgagataaaaaaaaaaaag

SEQ ID NO: 1971 - DNA, 548 bp, Homo sapiens
tgagggaaaaaatatttcttcttttattctaataatttttaaaaattttttgccaaaaatttttccactaaatagatgcattcaaattctatgtggtaatgtccttgaaataagtgctcccgtaaggctctcccaccaactcactgcacagttaggttaagtggtttcattttggcttttaatttttagggattgcttttacttataaaacagaattgaatatagttatctaagatagtaacctgatgccaaaacaaagcatttgggtagtttagcttttgttgctctctgtgtcctagtctcccttgtaaacgtggattgggaaatccacagtattatcacactgatagatcaacatgataatgtgttacaaacaagtttcagcttattccaagaatagaaccctccctgttatcattctaataaagatattgtaattcatgtttataaactgaaggggaaaaattatatgatcatctcaatagatggaaaatatcatttaataccaagtaaaacccattaaaaaggtttgcatgaaaaattttata

SEQ ID NO: 1972 - DNA, 1897 bp, Homo sapiens
ggaacatattgggaaggagggatccgggctgtaggctttgtgcatagcccacttctgaaaaacaagggaacagtgtgtaaggaacttgtgcacatcactgactggtaccccactctcatttcactggctgaaggacagattgatgaggacattcaactagatggctatgatatctgggagaccataagtgagggtcttcgctcaccccgagtagatattttgcataacattgaccccatatacaccaaggcaaaaaatggctcctgggcagcaggctatgggatctggaacactgcaatccagtcagccatcagagtgcagcactggaaattgcttacaggaaatcctggctacagcgactgggtcccccctcagtctttcagcaacctgggaccgaaccggtggcacaatgaacggatcaccttgtcaactggcaaaagtgtatggcttttcaacatcacagccgacccatatgagagggtggacctatctaacaggtatccaggaatcgtgaagaagctcctacggaggctctcacagttcaacaaaactgcagtgccggtcaggtatccccccaaagaccccagaagtaaccctaggctcaatggaggggtctggggaccatggtataaagaggaaaccaagaaaaagaagccaagcaaaaatcaggctgagaaaaagcaaaagaaaagcaaaaaaaagaagaagaaacagcagaaagcagtctcaggttcaacttgccattcaggtgttacttgtggataagcacaaatatttcctgtttggttaaactttaatcagttcttatctttcatctgtttcctaggtaaaccagcaaatttggctcgataatatcgctggcctaagcgtcaggcttgttttcatgctgtgccactccagagacttctgccacctggccgccacactgaaaactgtcctgctcagtgccaaggtgctactcttgcaagccacacttagagagagtggagatgtttatttctctcgctcctttagaaaacgtggtgagtcctgagttccactgctgtgcttcagtcaactgaccaaacactgctttgaattataggaggagaacaataacctaccatccgcaagcatgctaatttgatggaagttacagggtagcatgattaaaactacctttgataaattacagtcaaagattgtgtcacctcaaaggccttgaagaatatattttcttggtgaatttttgtatgtctgtcatatgacacttgggttttttaattaattctattttatatatataaatatatgtttcttttcctgtgaaaagctgtttttctcacatgtgaacagcttgcacctcattttaccatgcgtgagggaatggcaaataagaatgtttgagcacactgcccacaatgaatgtaactattttctaaacactttactagaagaacatttcagtataaaaaacctaatttatttttacagaaaaatattttgttgtttttataaaaagttatgcaaatgacttttatttttatttcctgcataccattagaagaattttatttcatttcttcaaattatcaagcactgtaatactataaattaatgtaatactgtgtgaattcagactataaaaaacatcattcagaaaactttataatcgtcattgttcaatcaagattttgaatgtaataagatgaatatattccttacaaattacttggaaattcaatgtttgtgcagagttgagacaactttattgtttctatcataaactatttatgtatcttaattattaaaatgatttactttatggcactagaaaatttactgtggcttttctgatctaacttctagctaaaattgtatcattggccctaaaaaataaaaatctttactaataggc

SEQ ID NO: 1973 - DNA, 1801 bp, Homo sapiens
ggaacatattgggaaggagggatccgggctgtaggctttgtgcatagcccacttctgaaaaacaagggaacagtgtgtaaggaacttgtgcacatcactgactggtaccccactctcatttcactggctgaaggacagattgatgaggacattcaactagatggctatgatatctgggagaccataagtgagggtcttcgctcaccccgagtagatattttgcataacattgaccccatatacaccaaggcaaaaaatggctcctgggcagcaggctatgggatctggaacactgcaatccagtcagccatcagagtgcagcactggaaattgcttacaggaaatcctggctacagcgactgggtcccccctcagtctttcagcaacctgggaccgaaccggtggcacaatgaacggatcaccttgtcaactggcaaaagtgtatggcttttcaacatcacagccgacccatatgagagggtggacctatctaacaggtatccaggaatcgtgaagaagctcctacggaggctctcacagttcaacaaaactgcagtgccggtcaggtatccccccaaagaccccagaagtaaccctaggctcaatggaggggtctggggaccatggtataaagaggaaaccaagaaaaagaagccaagcaaaaatcaggctgagaaaaagcaaaagaaaagcaaaaaaaagaagaagaaacagcagaaagcagtctcaggtaaaccagcaaatttggctcgataatatcgctggcctaagcgtcaggcttgttttcatgctgtgccactccagagacttctgccacctggccgccacactgaaaactgtcctgctcagtgccaaggtgctactcttgcaagccacacttagagagagtggagatgtttatttctctcgctcctttagaaaacgtggtgagtcctgagttccactgctgtgcttcagtcaactgaccaaacactgctttgaattataggaggagaacaataacctaccatccgcaagcatgctaatttgatggaagttacagggtagcatgattaaaactacctttgataaattacagtcaaagattgtgtcacctcaaaggccttgaagaatatattttcttggtgaatttttgtatgtctgtcatatgacacttgggttttttaattaattctattttatatatataaatatatgtttcttttcctgtgaaaagctgtttttctcacatgtgaacagcttgcacctcattttaccatgcgtgagggaatggcaaataagaatgtttgagcacactgcccacaatgaatgtaactattttctaaacactttactagaagaacatttcagtataaaaaacctaatttatttttacagaaaaatattttgttgtttttataaaaagttatgcaaatgacttttatttttatttcctgcataccattagaagaattttatttcatttcttcaaattatcaagcactgtaatactataaattaatgtaatactgtgtgaattcagactataaaaaacatcattcagaaaactttataatcgtcattgttcaatcaagattttgaatgtaataagatgaatatattccttacaaattacttggaaattcaatgtttgtgcagagttgagacaactttattgtttctatcataaactatttatgtatcttaattattaaaatgatttactttatggcactagaaaatttactgtggcttttctgatctaacttctagctaaaattgtatcattggccctaaaaaataaaaatctttactaataggc

SEQ ID NO: 1974 - DNA, 401 bp, Homo sapiens
gagagtttaactggctaagaccaggccagtacatgagcgcaggcccaagatccgaaagggaaagtcctgaacgcccccttccccctgtcttttcggcggggctttgggagtttgcagggtgttctgagtgtttgggcctcagggattctcacctccgggagattccaggagctgtagggggtggaatgcgagtaggaggagagttgcagatggatatcgtggcctgctgatggttttggagcccaggtccagacatttcttgattgaagtagacattcaagaagtgtgaaatgcacagtcagaaaatctgggacttctctttttccttgtcagaatcaggattgaaaaatgattcagcggggaatagcttctttacagtgagagcccgtgttattgatttt

SEQ ID NO: 1975 - DNA, 326 bp, Homo sapiens
tcttttacgttcctggataacctgtaattttacaatactgatctagaaaccagaagctgccacaaatgatggtgctaaatctgtgcttgaaatggtgggacagaaatgcaaggtgactttacaaaggatggatgatttgagtctctgttcctatatccatgatttgactgtgcaaaagaagtccttactacttctccacccaccaattctggtgacagttagggggtttgtggccctagcctacatcattctcccctgctggatgcttcctgctcttgaacatcggactccaggttcttcagttttgggactcggactggctctcc

SEQ ID NO: 1976 - DNA, 511 bp, Homo sapiens
tatgcctccacatatgcacagcctcccccattatcagcagttcttcaccagagtggtacgtttgttacaatcgaagaacctacgttggtacatcataatcgcccaaagactctagtttagactagggttcactcttagtattgtattttgtgttgttttagacaaacctgtaatgacgggtatcattatagtatcatacagaatagtttcactgccccgaaatttccctgtgcttctccatctgtctcccacaccaacccctggcaaccactgacctttgtattttgtttgttggttcattttttttagatacctcatctactatttgatgatctttttactgtctccatagttttaccttttccagaatgtcatatggttggaatcatacactgtgttgccttttcaggttgccttcttccacttagtatagtgctaaatgatacaattggccctccatatctataagtgccatgtctgtggattcagccaactgtggattggagatatt

SEQ ID NO: 1977 - DNA, 254 bp, Homo sapiens
tacatctgaaaaatgaattaggatacccaagttttagtctcaattcagtcaaaactcatttgttgagtttctcctttaagccaagcaccaggctgcaaatatcaagtcttggctctataactgaaaaggaacattatgtagagaggcactggccaatacagcagccacagggcctcatggggcaagtgagcacttgaaacatgcacagaataaatgaaatttttaacattattaaatttaaatatcaaagtgat

SEQ ID NO: 1978 - DNA, 416 bp, Homo sapiens
ccaaattctgacagcatgcttatacgttatctcaacaggaaagaaaagagagtggacttgtcatgtggctctatatttgactctggcttattttatcaatgccataaaggcatagaagacttatcatatttacagacagcacaaggctggtagggataacaagtaaaggataaatcccatataggctgaatattgtgtcaaaactaacttaattgtgatgaaagtaaagccttatatctaggttcatttggtataggactaggtctcttacatgtgattgatctaagggttttagttgtctgcactttaaccaagtcatgtgatgtagcagccaaagaatgctttgcttgcaggagctaggaaaaagaggatttaaaatatatataaaaaagaaaataaaaaagaaaaagaaatag

SEQ ID NO: 1979 - DNA, 491 bp, Homo sapiens
agccctctttactctctgaaacttagatatcttcagatttcccttggaagttcaatgcccttctatcatatctgctaatatcttggtgttctcccactcttctgtgccaggctccttaactcatatatgtgagtcttcaaagattcacggaagatgtttattaagaaaaaaactgtgcatggacttcaaaacttttttgcaccaaaataaactcatactaacctgttataatgtatctgaacaggatatagtttgagatactaagaaggataagacattagtttacaaagagtctctatcagagcaacatgagttctgctaaaattaagaacaaacatctattgatggtaaagcttgggtggaagaacagtgaaatcactgatgctttttgaaaagtttctggggacaaagccccaaagaaaccagcaatttacaaatagactgcttgttttaagaagggaatagtgatgttgaagatgaagcgtgcagca

SEQ ID NO: 1980 - DNA, 439 bp, Homo sapiens
tgaatgttgtatacgttatttcattcactccccatatataaactgccaggctggtattggtatctgcatctcacagatgaggcaaatgaaacttggagaaatgaagtaacttatttaaaaacacacagcttggctgggtgaggtggttcacgcctgtaatcccagcaactttgggaggccgaggtgggtggatcccttgaggtcaggagttcaagaccagtctggccaacatggtgaaaccctgtctgtactaaaaatacaaaaatgagccagcatggtggcaggcacctgtaatcccagctacttgggaagctgaggcaggagaatgacttgaaccagggaggcggaggttgcagtgagccaagatcacaccactgcactccagcatgggtgacaagagtgaaactctgtctcaaaaaacaaaacaacaaaacaaaac

SEQ ID NO: 1981 - DNA, 266 bp, Homo sapiens
cagagctgagacaagaaatttcacagctttttcctattgtggaacaaacaatctgagtttaaaacatattgacttactgaattaaagtaagtcactccacctcttaaagactcagtcacacatccaattttccaggggcctgtggccactgagtgtcacagagtgtggaaggctgtaggggccagtccagaggagagaccacatggcctgattgcccagtagaaattgatattcacaaaagaatgctggctcaaaaaaataaattg

SEQ ID NO: 1982 - DNA, 948 bp, Homo sapiens
aatgagtcatagtcgaggccggtgttaatcaggcgagggcatgcttattgggaagcacaggtgggcaattcctcttggtacctctatgatggagaagacgatacaccctcctaccgtggattcctcattttctggggctatatcattgttctcaacaccatggtacccatctctctctatgtcagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattgtaagaaccccagaaggcaatatcaagctttactgtaaaggtgctgacactgttatttatgaacggttacatcgaatgaatcctactaagcaagaaacacaggatgccctggatatctttgcaaatgaaactcttagaaccctatgcctttgctacaaggaaatt

SEQ ID NO: 1983 - DNA, 631 bp, Homo sapiens
ggctcggtcctgcatttactccatggcgcagcccatctgacccccacaggagcctcagcagaggcctcaacaatgagctctgcatttgtttttacagcttttctgggatttctctcgcttccttgttaggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattggtaagtccccctcagagtctgtctatgaatcgctcatttagatgttgcttgtgcccattgtattgagtggcatcaggataaagcagccagtgaaagagctacttggctcctgggagatttctgcagctttactgaaactggtattgttggctgggcgtggtggctcacgcctgtaatcccagcactttgggaggccgaggcgggtggatcacgaggtcaggagatcgagaccatcctggctaacacggtgaaaccccgtctctactaaaaatacaaaaaaaattagccatggagtaaatgctggtaccgtgta

SEQ ID NO: 1984 - DNA, 892 bp, Homo sapiens
gggaaatctcactgagcaattttgagtggaaattacttgtctaaaatcagcttgaccctgaagcctgagaatgatgcatgtggttaggagaaaccagaggctgagtgcatgggcttgtctccttgtagagggcttagtttgggctgatataacaaaagaccttcgaaatttattgctcagagttctggaggctgggaagtctcaaatcaaagcatcggcagattcagggtctggcaaaggctcactttctgctttataggcacagccggtgccttctagctatgtcctcgcatggcagaaggggcaagcaagctcctttgagccactttaataagggcactaatcccattcataagggtggagccctcatgacctaatgaccttctaaaggccccacctcaatactgttgaattggggattgggtttcaacatatgaatttggagggggattctaacattcagaccatagcagtaaataagcagcttgctctcgtctgtacaatgagaataaaatctctactacttgccactcgtatccgagctctctacggaaaataatcttctgtcttcctagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggtaagtggaagccgtcactcattttctgggtgagtggggctgcctgccgtgtgcaggtcattacttggactatagcctgtctcctggcattgctggtgccctctcgat

SEQ ID NO: 1985 - DNA, 1062 bp, Homo sapiens
ttgaattttccattttcaggtgctgacactaaaataatgaagaatagtgggaaaaccagatttaaaagaactaaaattgattacttgatgaactacatggtttacacgatctttgttgttcttattctgctttctgctggtcttgccatcggccatgcttattgggaagcacaggtgggcaattcctcttggtacctctatgatggagaagacgatacaccctcctaccgtggattcctcattttctggggctatatcattgttctcaacaccatggtacccatctctctctatgtcagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggggaccatcgggatgcctctcaacacaaccacaacaaaatagagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattgtaagaaccccagaaggcaatatcaagctttactgtaaaggtgctgacactgttatttatgaacggttacatcgaatgaatcctactaagcaagaaacacaggatgccctggatatctttgcaaatgaaactcttagaaccctatgcctttgctacaaggaaatt

SEQ ID NO: 1986 - DNA, 2255 bp, Homo sapiens
cttgagacaggtgggacatgtcatttctcacatgaggtcccggcgagaaggacctgcttccatcagattcacacttgggagaggggcccggcctccaggagcgccaggcagaaagggcacccattaggaagaagaacacagaggccatgggagtgaaaagtttgatgctggaaagcaacagtagcacattctgctacagagcggaatgaaaaaccctggggagcaaattcctgagccagagaatggagcggaggaaccagccaaggaggataaagagacctgcgtgctctgaggctgcccgaccctgagctccagaacagaccatcgagttcaggagacaagcatgtcagccatgacacaaggcagatgagagggacccccagcgtccacacgtggaggcagcgggggcagccgtgacttccttctgcagtgttgattcagctccctttgaaggcggatccatacaaacaggctgaccatcagggctggtcccaggccacacaggctgggtgcaatgcagaaatggacgatctgccccggggaaggcaggtgagtgtaggaaggagggagggctgcgagaagctgggggcagcctccatccccctgtggcctgggtgggcctgtgcccccccaaccccccgacgcagcttcccacactgggagcacagttcctccctcctctgccttcctctgcgtggtgtggctcctccttgagggagagagctgaggaggtggcattcttgcttccctgactcacccaaaggaagatttcacagcccctggcaagggctgccagacaggctcacctgtcaccccctgtccagggacagactgaccggtagccttggctgggtggggagttatgctgggaagtcttccaggccccctgggggtgggaagatgctcaatgttcaaaggagatggaacgaggaaaacagttaagcaacgatggactccagggggaaaaccggagaagaagaaactgtaattccagtccgtccacatggcccagcagtgaacgacaattgcatggtcagagagagcaaaagcaccacgccgactgaaagcagctcgaatgtggtggggcagtgggagataatgccctcatctaccaaaacaagatctgccaccttcgcagaccactaaacctcattcctccacccacctccccacccccatgaaggccaactgaccagagagcagggctcccgagggtcgggtcgggtcgggtcgggttgggtcgggtgggtgcctcttaccctaactgaggctctgccctggactcggagtccacttgctgtcaaagcatgccactcttctttctgatacttgacatatttcttttcccgttcaattcatggtttctgcccaaacggagccacgtgaggacgtctttggggatgtgtctccaagaaaagtgtgggctgccttcctcaccctggatgcctgtgggcagccttcctcaccctggatgcctgtgggctgccttcctcaccctggatgcctgtgggcagccttcctcaccctggatgcctgtgggctgccttcctcaccctggatgcctgtgggcagccttcctcaccctggatgcctgtgggcagccttcctcaccctggatgcctgtgacttggtttccatgggggcttcctaagctcagggaccccaagcctccatcaaatctaatgacccgccttgtctctgaacacacctgtgttgtccccgagcccctcaccaaccccctctgcaacccggcccacgcatttcccatcctgaagggtccagctcataggccggcccatgtgttccctttacccctgctttgtccctacctggtggggagctgtcccttctgggccctagtgtggcacttcacacacaaatgtgtcctgtgggtggtatctgggcctccccctgcagtgaggggatgaccaatgtgcagagctcactgggcctggatatgggctcgggtggcacagaacagagagaaagtgctccgtaaaagtgagctgcgatgcggaggtgggcaagctcttccctggagggggaagagctctcaacccagagggatctgaccaggaaggttcaccccccctccacccaggaagcccctgcagacagtatgtgttttaggctttgctggccaaatggtctctgccgcgactactcagctctgccattgtggctgcagagtgaccatagaccttctgaaagtgaatgagtatgactgtgttccaataaaactttattgacaaaaa

SEQ ID NO: 1987 - DNA, 2236 bp, Homo sapiens
cttgagacaggtgggacatgtcatttctcacatgaggtcccggcgagaaggacctgcttccatcagattcacacttgggagaggggcccggcctccaggagcgccaggcagaaagggcacccattaggaagaagaacacagaggccatgggagtgaaaagtttgatgctggaaagcaacagtagcacattctgctacagagcggaatgaaaaaccctggggagcaaattcctgagccagagaatggagcggaggaaccagccaaggaggataaagaggtgggaacaggcaagaaaacctggacctgcgtgctctgaggctgcccgaccctgagctccagaacagaccatcgagttcaggagacaagcatgtcagccatgacacaaggcagatgagagggacccccagcgtccacacgtggaggcagcgggggcagccgatccatacaaacaggctgaccatcagggctggtcccaggccacacaggctgggtgcaatgcagaaatggacgatctgccccggggaaggcaggtgagtgtaggaaggagggagggctgcgagaagctgggggcagcctccatccccctgtggcctgggtgggcctgtgcccccccaaccccccgacgcagcttcccacactgggagcacagttcctccctcctctgccttcctctgcgtggtgtggctcctccttgagggagagagctgaggaggtggcattcttgcttccctgactcacccaaaggaagatttcacagcccctggcaagggctgccagacaggctcacctgtcaccccctgtccagggacagactgaccggtagccttggctgggtggggagttatgctgggaagtcttccaggccccctgggggtgggaagatgctcaatgttcaaaggagatggaacgaggaaaacagttaagcaacgatggactccagggggaaaaccggagaagaagaaactgtaattccagtccgtccacatggcccagcagtgaacgacaattgcatggtcagagagagcaaaagcaccacgccgactgaaagcagctcgaatgtggtggggcagtgggagataatgccctcatctaccaaaacaagatctgccaccttcgcagaccactaaacctcattcctccacccacctccccacccccatgaaggccaactgaccagagagcagggctcccgagggtcgggtcgggtcgggtcgggttgggtcgggtgggtgcctcttaccctaactgaggctctgccctggactcggagtccacttgctgtcaaagcatgccactcttctttctgatacttgacatatttcttttcccgttcaattcatggtttctgcccaaacggagccacgtgaggacgtctttggggatgtgtctccaagaaaagtgtgggctgccttcctcaccctggatgcctgtgggcagccttcctcaccctggatgcctgtgggctgccttcctcaccctggatgcctgtgggcagccttcctcaccctggatgcctgtgggctgccttcctcaccctggatgcctgtgggcagccttcctcaccctggatgcctgtgggcagccttcctcaccctggatgcctgtgacttggtttccatgggggcttcctaagctcagggaccccaagcctccatcaaatctaatgacccgccttgtctctgaacacacctgtgttgtccccgagcccctcaccaaccccctctgcaacccggcccacgcatttcccatcctgaagggtccagctcataggccggcccatgtgttccctttacccctgctttgtccctacctggtggggagctgtcccttctgggccctagtgtggcacttcacacacaaatgtgtcctgtgggtggtatctgggcctccccctgcagtgaggggatgaccaatgtgcagagctcactgggcctggatatgggctcgggtggcacagaacagagagaaagtgctccgtaaaagtgagctgcgatgcggaggtgggcaagctcttccctggagggggaagagctctcaacccagagggatctgaccaggaaggttcaccccccctccacccaggaagcccctgcagacagtatgtgttttaggctttgctggccaaatggtctctgccgcgactactcagctctgccattgtggctgcagagtgaccatagaccttctgaaagtgaatgagtatgactgtgttccaataaaactttattgacaaaaa

SEQ ID NO: 1988 - DNA, 2226 bp, Homo sapiens
cttgagacaggtgggacatgtcatttctcacatgaggtcccggcgagaaggacctgcttccatcagattcacacttgggagaggggcccggcctccaggagcgccaggcagaaagggcacccattaggaagaagaacacagaggccatgggagtgaaaagtttgatgctggaaagcaacagtagcacattctgctacagagcggaatgaaaaaccctggggagcaaattcctgagccagagaatggagcggaggaaccagccaaggaggataaagagacctgcgtgctctgaggctgcccgaccctgagctccagaacagaccatcgagttcaggagacaagcatgtcagccatgacacaaggcagatgagagggacccccagcgtccacacgtggaggcagcgggggcagccgtgacttccttctgcagtgttgattcagctccctttgaaggcggatccatacaaacaggctgaccatcagggctggtcccaggccacacaggctgggtgcaatgcagaaatggacgatctgccccggggaaggcaggtgagtgtaggaaggagggagggctgcgagaagctgggggcagcctccatccccctgtggcctgggtgggcctgtgcccccccaaccccccgacgcagcttcccacactgggagcacagttcctccctcctctgccttcctctgcgtggtgtggctcctccttgagggagagagctgaggaggtggcattcttgcttccctgactcacccaaaggaagatttcacagcccctggcaagggctgccagacaggctcacctgtcaccccctgtccagggacagactgaccggtagccttggctgggtggggagttatgctgggaagtcttccaggccccctgggggtgggaagatgctcaatgttcaaaggagatggaacgaggaaaacagttaagcaacgatggactccagggggaaaaccggagaagaagaaactgtaattccagtccgtccacatggcccagcagtgaacgacaattgcatggtcagagagagcaaaagcaccacgccgactgaaagcagctcgaatgtggtggggcagtgggagataatgccctcatctaccaaaacaagatctgccaccttcgcagaccactaaacctcattcctccacccacctccccacccccatgaaggccaactgaccagagagcagggctcccgagggtcgggtcgggtcgggtcgggttgggtcgggtgggtgcctcttaccctaactgaggctctgccctggactcggagtccacttgctgtcaaagcatgccactcttctttctgatacttgacatatttcttttcccgttcaattcatggtttctgcccaaacggagccacgtgaggacgtctttggggatgtgtctccaagaaaagtgtgggctgccttcctcaccctggatgcctgtgggcagccttcctcaccctggatgcctgtgggcagccttcctcaccctggatgcctgtgggctgccttcctcaccctggatgcctgtgggcagccttcctcaccctggatgcctgtgggcagccttcctcaccctggatgcctgtgacttggtttccatgggggcttcctaagctcagggaccccaagcctccatcaaatctaatgacccgccttgtctctgaacacacctgtgttgtccccgagcccctcaccaaccccctctgcaacccggcccacgcatttcccatcctgaagggtccagctcataggccggcccatgtgttccctttacccctgctttgtccctacctggtggggagctgtcccttctgggccctagtgtggcacttcacacacaaatgtgtcctgtgggtggtatctgggcctccccctgcagtgaggggatgaccaatgtgcagagctcactgggcctggatatgggctcgggtggcacagaacagagagaaagtgctccgtaaaagtgagctgcgatgcggaggtgggcaagctcttccctggagggggaagagctctcaacccagagggatctgaccaggaaggttcaccccccctccacccaggaagcccctgcagacagtatgtgttttaggctttgctggccaaatggtctctgccgcgactactcagctctgccattgtggctgcagagtgaccatagaccttctgaaagtgaatgagtatgactgtgttccaataaaactttattgacaaaaa

SEQ ID NO: 1989 - DNA, 2659 bp, Homo sapiens
cttgagacaggtgggacatgtcatttctcacatgaggtcccggcgagaaggacctgcttccatcagattcacacttgggagaggggcccggcctccaggagcgccaggcagaaagggcacccattaggaagaagaacacagaggccatgggagtgaaaagtttgatgctggaaagcaacagtagcacattctgctacagagcggaatgaaaaaccctggggagcaaattcctgagccagagaatggagcggaggaaccagccaaggaggataaagagacctgcgtgctctgaggctgcccgaccctgagctccagaacagaccatcgagttcaggagacaagcatgtcagccatgacacaaggcagatgagagggacccccagcgtccacacgtggaggcagcgggggcagccgtgacttccttctgcagtgttgattcagctccctttgaaggcggatccatacaaacaggctgaccatcagggctggtcccaggccacacaggctgggtgcaatgcagaaatggacgatctgccccggggaaggcaggtgagtgtaggaaggagggagggctgcgagaagctgggggcagcctccatccccctgtggcctgggtgggcctgtgcccccccaaccccccgacgcagcttcccacactgggagcacagttcctccctcctctgccttcctctgcgtggtgtggctcctccttgagggagagagctgaggaggtggcattcttgcttccctgactcacccaaaggaagatttcacagcccctggcaagggctgccagacaggctcacctgtcaccccctgtccagggacagactgaccggtagccttggctgggtggggagttatgctgggaagtcttccaggccccctgggggtgggaagatgctcaatgttcaaaggagatggaacgaggaaaacagttaagcaacgatggactccagggggaaaaccggagaagaagaaactgtaattccagtccgtccacatggcccagcagtgaacgacaattgcatggtcagagagagcaaaagcaccacgccgactgaaagcagctcgaatgtggtggggcagtgggagataatgccctcatctaccaaaacaagatctgccaccttcgcagaccactaaacctcattcctccacccacctccccacccccatgaaggccaactgaccagagagcagggctcccgagggtcgggtcgggtcgggtcgggttgggtcgggtgggtgcctcttaccctaactgaggctctgccctggactcggagtccacttgctgtcaaagcatgccactcttctttctgatacttgacatatttcttttcccgttcaattcatggtttctgcccaaacggagccacgtgaggacgtctttggggatgtgtctccaagaaaagtgtgggctgccttcctcaccctggatgcctgtgggcagccttcctcaccctggatgcctgtgggctgccttcctcaccctggatgcctgtgggcagccttcctcaccctggatgcctgtgggctgccttcctcaccctggatgcctgtgggcagccttcctcaccctggatgcctgtgggcagccttcctcaccctggatgcctgtgacttggtttccatgggggcttcctaagctcagggaccccaagcctccatcaaatctaatgacccgccttgtctctgaacacacctgtgttgtccccgagcccctcaccaaccccctctgcaacccggcccacgcatttcccatcctgaagggtccagctcataggccggcccatgtgttccctttacccctgctttgtccctacctggtggggagctgtcccttctgggccctagtgtggcacttcacacacaaatgtgtcctgtgggtggtatctgggcctccccctgcagtgaggggatgaccaatgtgcagagctcactgggcctggatatgggctcgggtggcacagaacagagagaaagtgctccgtaaaagtgagctgcgatgcggaggtgggcaagctcttccctggagggggaagagctctcaacccagagggatctgaccaggaaggttcaccccccctccacccaggaagcccctgcagacagtatgtgttttaggctttgctggccaaatggtctctgccgcgactactcagctctgccattgtggctgcagagtgaccatagaccttctgaaagtgaatgagtatgactgtgttccaataaaactttattgacaaaaacaggtggagggccagcctaagggcccaagtttgtaggtctctattctagaccagtgattctctggagaggaatggggcatggggagtggggacagtgtgtgggagaagaggtgggacacaggcacgtgggaatggtgcggacatggaggacattggaggtggggaagagctagagaacctaaacactgacgctggaccctggtcaacactaggtctctccacagcctcctcttttagcctctccctccagtttcaaaatgactcctcctctgaggggactcaggctccccaccctgctccccagttcccaccagaaaccccaagtgggtgttccagcctctgccccacaaggcccccatggaaggcagcaccgccaggcagggacctttcctcgctgcccctcc

SEQ ID NO: 1990 - DNA, 2914 bp, Homo sapiens
cttgagacaggtgggacatgtcatttctcacatgaggtcccggcgagaaggacctgcttccatcagattcacacttgggagaggggcccggcctccaggagcgccaggcagaaagggcacccattaggaagaagaacacagaggccatgggagtgaaaagtttgatgctggaaagcaacagtagcacattctgctacagagcggaatgaaaaaccctggggagcaaattcctgagccagagaatggagcggaggaaccagccaaggaggataaagagacctgcgtgctctgaggctgcccgaccctgagctccagaacagaccatcgagttcaggagacaagcatgtcagccatgacacaaggcagatgagagggacccccagcgtccacacgtggaggcagcgggggcagccgtgacttccttctgcagtgttgattcagctccctttgaaggcggatccatacaaacaggctgaccatcagggctggtcccaggccacacaggctgggtgcaatgcagaaatggacgatctgccccggggaaggcaggtgagtgtaggaaggagggagggctgcgagaagctgggggcagcctccatccccctgtggcctgggtgggcctgtgcccccccaaccccccgacgcagcttcccacactgggagcacagttcctccctcctctgccttcctctgcgtggtgtggctcctccttgagggagagagctgaggaggtggcattcttgcttccctgactcacccaaaggaagatttcacagcccctggcaagggctgccagacaggctcacctgtcaccccctgtccagggacagactgaccggtagccttggctgggtggggagttatgctgggaagtcttccaggccccctgggggtgggaagatgctcaatgttcaaaggagatggaacgaggaaaacagttaagcaacgatggactccagggggaaaaccggagaagaagaaactgtaattccagtccgtccacatggcccagcagtgaacgacaattgcatggtcagagagagcaaaagcaccacgccgactgaaagcagctcgaatgtggtggggcagtgggagataatgccctcatctaccaaaacaagatctgccaccttcgcagaccactaaacctcattcctccacccacctccccacccccatgaaggccaactgaccagagagcagggctcccgagggtcgggtcgggtcgggtcgggttgggtcgggtgggtgcctcttaccctaactgaggctctgccctggactcggagtccacttgctgtcaaagcatgccactcttctttctgatacttgacatatttcttttcccgttcaattcatggtttctgcccaaacggagccacgtgaggacgtctttggggatgtgtctccaagaaaagtgtgggctgccttcctcaccctggatgcctgtgggcagccttcctcaccctggatgcctgtgggctgccttcctcaccctggatgcctgtgggcagccttcctcaccctggatgcctgtgggctgccttcctcaccctggatgcctgtgggcagccttcctcaccctggatgcctgtgggcagccttcctcaccctggatgcctgtgacttggtttccatgggggcttcctaagctcagggaccccaagcctccatcaaatctaatgacccgccttgtctctgaacacacctgtgttgtccccgagcccctcaccaaccccctctgcaacccggcccacgcatttcccatcctgaagggtccagctcataggccggcccatgtgttccctttacccctgctttgtccctacctggtggggagctgtcccttctgggccctagtgtggcacttcacacacaaatgtgtcctgtgggtggtatctgggcctccccctgcagtgaggggatgaccaatgtgcagagctcactgggcctggatatgggctcgggtggcacagaacagagagaaagtgctccgtaaaagtgagctgcgatgcggaggtgggcaagctcttccctggagggggaagagctctcaacccagagggatctgaccaggaaggttcaccccccctccacccaggaagcccctgcagacagtatgtgttttaggctttgctggccaaatggtctctgccgcgactactcagctctgccattgtggctgcagagtgaccatagaccttctgaaagtgaatgagtatgactgtgttccaataaaactttattgacaaaaaaaaaaaaaaaaaaaaaaaaaaaaaaaaaaaaaaaaaaaaaaaaaaaaaaaaagaaagaaaaaaaaaaaaaaaaaaaaaaaaaaaaataaaaacaagaacaaaaagaacaaaaaaaaaaaataaaacaaaggagcgggcgcgcgcatcactacgctcacccccgagagggcacagcgcaccaagctgcacagccccattgttatatataaacagaagaggcggcacaaatgatgtaagtagaattattaataaagagtacagaagacgagcgcgcaggcagagtcagttgttttaaacatagcgaataacagatgtagcagaagaagttagctattaaggtaatagtagtttaatgtgtgcagaaacagatcgcacttatttcggggtggaggtgcagaaaagtattagtaagatgtcacaacacgaacgactaggaatagagtaaggacccaccggacggcgagacgagagacattaaacaaccctaatcgagaggagactgtgcagactcaagtggagggggagaaacaaaaagcaggagtacgagtcagctgtgtgccactcgagagaactaaaaccgagatgcacagagtataaggacacgaaagaaaaagtatcacaaacgccgaggagagtaattagacaaaaggggggggggg

SEQ ID NO: 1991 - DNA, 351 bp, Homo sapiens
catgtgcggcagggctcggaggcctcagaatcaataaggaccctttagatttaaaactaatgattttctgtgttcagcaaaagtcaaaatctctcaaagttgccattgttgtctctgagtttttccccagagaacaagagatggtgtgataaatcatcatgcttgcaacacgcacgtcagaagagacttgaactagaccagagatggatagcgcgagccccaaacatcttaattatttcagtcttgaattgagcaaaacccttaaactagaactgtgggaacagtgatcctaacagcagtagacacaccatctaatagggtcatcatgccccccaagagtacaagtgtgac

SEQ ID NO: 1992 - DNA, 396 bp, Homo sapiens
agatttgctcatgttttagatggggctagaatcatacatggcaaacagtgctgttgagagtaaggcacatatgttaaaacactgaatatttattcattctcaaatatttatggagtacctgtccatagatacagtaatatatgagatacactccttgccctccaggaactcactgctgagttaatgagatagaggagaaaaagggcaatgacaatacagtgtattaaggaagaagctatgaggcatatacaaattgcttggagatcacacaggaggagatagtttactaaaatctggctgatcaagagcagtctcagggtctgctatcctggtgtgcagccaagagcctctttgccacagcctaccatgaggccaagagcccagctacagctatat

SEQ ID NO: 1993 - DNA, 694 bp, Homo sapiens
ttttctgctcctatagcctggcaaccttgtggtacatgggactacgtcctttaaactacccaggagcaaagttggacttccatgaaaaaggtttgtgcagatctaaaacctctcatctatttcactaaaaggacttccccttctaactgtcacccttaccaatgtaaccctgtcctctctatcaccacctccacctgtctttaactaactctagacctgtccttaattgcttttatggtattggaataggaattaaaagaaattaaagaatgtgtaaggagaaactcagttgtatgtaagaaaacccaattccccctgagaaagagaaagagttggagtcctttaaaaattaactgcctgtttttctgtggctagtgagccttatctctcctcctttcccagacattgtgaagaccctgtttctctagctgtgcagctgcaaggtcactagacagataaactcaagttgtaaaacatgtttttccttgaaaagtaagaaatgctgtaatgcatttctcaattaattaaataactgtctttgtttctcgcttctgtaatatgcttccccctgcacagatctccacccaccctacaaaatgcttaaaaggtaacttaactctttgttctgggctcagtcctttgggctgagtactgggccggtgcacctaaataataaatatcttcctgaacccca

SEQ ID NO: 1994 - DNA, 464 bp, Homo sapiens
acagatcaaaccagccacaacattcccttaagccaaagcctaatacagagcgaggtcccaactctcttcaattctgtgaaggctgaatgatgtgaggaagctgtgaacataagtttgaagctagcagaggttggcccacaaggcttaaggaaagaagccgtctccgtaatatgagtgtgaggtgaggcagcaggctctccagaagatcctgctacggtcacaatggaggtggccgcactcaaccacagatcttcagtgtagaggaagcaaccttgaactggaagaagacaccatgcaggcctttcataggtagggagaagtcaatgcctggcttcagagcttcaaaagacagtctgactctttgccgtgactttaaaacccatctatgcctagtgttccattattggaacgctaagcatgtgcaagtttatattctgcttaaggtcactgccaagatctgattg

SEQ ID NO: 1995 - DNA, 539 bp, Homo sapiens
agttgtcagaaaatataatctacatttttcttttcatggaaggcatgcttgggataatgtcgtttacaattcagtttcaactctgggacccactggccaaaggctgaagctggatggtagatgcatcttctgtctgtccagcagggctactatgctggagcgccttatacagggagagatactgtggtgatcatgctacaggtgtatattttttaactgactcattaatttgggggagaaaacccagcctttcactcaaaaacatgaccccacttataactggggaatcaaagaaagccctcctttaattctagctttgcaaacttagtaatatctacttaggaaaacattatttttcaatttagactatgagttaaaatcactttgaaaatgaaaatgactgggtttttcactagatttactgaaaataaaaaataaactaggatctctgggtgggggctagctgagagggcttcaagttcatagagagacatataccaggaaacaacaaaacacagtaggttaccggtgctgcaata

SEQ ID NO: 1996 - DNA, 504 bp, Homo sapiens
aggctggtctcgaactcccgacctcaggtattattattatcctcactttacagatgaagaaatggaggcagaaaaattaagatgtttgcaccactttgtgcaggaaatgtggtaactgaggtcacagccaggccatctggctctgaggcctgcaccacactgttgtgctacttttgcatttacgggaaagggctaagcacagacaaaatgtgagtgcgttatttgggaattttaagcaaagcctcattggtaagttggctcattttcttcccttctatggcagttacacagttttttattcttaactcatgtgggacaaggaagggtcttttgaaatgaaaggatcaaatctgagcttttaaattctagtctgttttctcctcttttctgctaagagagtagatttctaaatcagttctgattttatttacccttacagtttagagtgtgcctgactttcatgatacttggctgtcttctgccataataaagtgtctgccttta

SEQ ID NO: 1997 - DNA, 307 bp, Homo sapiens
ccagctgcttgctttcaggctataatgtccttcttgggtcttcagactgcagttaccttttcttgatgaagcatgtggcagccacttctcttgaacagctgggagtctggtccctgatgagcttcatttgtgttcctccttccacagtggctgactcctggtttagtaaccttggtttcttccattactttgtaacttacaactgggttagaaaaaccaatttttaatttgtcagtaagatctcttctggttttgcaccctgttgtatgctgtgtgccaagtgcttaggtggttttctcctcgctgc

SEQ ID NO: 1998 - DNA, 360 bp, Homo sapiens
gtatgccataggtgctcaaatagtcactgaataaaatagtgaaatgatgaatataagccttgctccacttaatctaatacctctctttacctcaaaaaatactgagcatgctaatttgaaaaagagttaagactcagtagatgggagttggatgcgtgttgatttaaaaccagccttaggtaagaaaggtgctagttggtggaattagtcagtgatgagacaatatattcatttctctctactcaatggttttagcaacttaatatttcaataattagctcatagcataaaatttgtctcagcaattagaataatattttctgagagttggccaaggctttgcattttcttaaaaaaaaa

SEQ ID NO: 1999 - DNA, 483 bp, Homo sapiens
tgtgccccagccacagtgagctgcttacatgttttcaaatgggttgtgttcctttccctcccagcggctttgtccacactgttccctttgcttagaatgttttctccaaggctctctagaacctgtttttacctgatttataccagaaaaccttagcccccagcccagaaccattcttcctcatggaagctcttccagatccttcagggtgtattgggttcttctaagttgctgtgatcttgcagttttcctttttagcttacctcaacttaaaataatgaagaatctctgataatgtgggtgtgggtgtctctctcttccttaaattggaagctccttgagggcagggactgcgtccgttttgttatcgatgattatattgatagtgcctagcaaaagtaggcacaaaataaatatttttttgaatgatatataaaaagagtaaattagaataacccttttggaggatgaattggcaatatg

SEQ ID NO: 2000 - DNA, 400 bp, Homo sapiens
agtacttcattcctttttatagctgaataatatttgattatgcatctaccataattttttttccttcaacttttactttaagttcaggggtacatgtgcatgatgtgtaggtttgttacataggtaagcttgtgccacgatggtttgctgcacaaatcatcccatcacctaggtattaagcccagcatccattagctattcttcctgatattctccgtcctccactcaccctgtgacaggttccagtgtgtgttgtcccccagttgtatccatgtgtactcatcattcggctcctacttataagtgagaacatgcagtgtttggttttctattcctgcattagtttgcagaggacactggctttcaactccatccatgtccctccagaggacatgatctc

SEQ ID NO: 2001 - DNA, 433 bp, Homo sapiens
ccaccaaacttaccatgtgaaggacagcacatgggcattctttctgagacctgcaaagaaaacaaagggagaggctaagcagacaaaggaaaactctttcttctcaaatcaatcagataatgaactcctgttccctttaggagaaatgagtgggtggggagagaaaagcaagcagttgacctctggaggtccttagacttaaaaacataaagcccaaggaagaaaattcctccccagcattaacttggaccagtaatgtttttctatttatattccatatgtaaatatgcctgtgaggtattatgtattgtctttgtgcctttaagtgcatttctttaaaaaatctgtaactttaaacttaaatagaaaggcacaaaatggattgttattttatacaatggagttctgatattaattattgttacttctcaca

SEQ ID NO: 2002 - DNA, 448 bp, Homo sapiens
aggtttttgaaagtttaaactatacctgctgacagctcccttattaagtcctactcaactgttatctctcacaggggttaggctgtctttccaaactcttccctttgttgaaactgaccgatctgattgtcaacataaagtaagtacctcctcttgatgatagccctatgctcttttagggatttgggtcctgagaagggatcaacactggcaaacctaccaaaggccaaaaacctgacattttctttcctgaatttcaaaaattcctttggaattcccagggtagatgcattcaactctagaattccatgtacattcaatattgagttaagcctgattgcacatctgcaactccatgagccaggaaagcacttaccacagtgctccacggagttattaagttcttaagggaaaaacgtatgcagagaagaggaagaaagtctaaggt

SEQ ID NO: 2003 - DNA, 517 bp, Homo sapiens
taatcttgagctctattagttcctgtgtatttttaacatgatatatggattttccttttctattgttcaaacatgaaaatgttttaaaaagaaaaacatgcctttattgccattttttaaagtattgaaggggataaaaaggaaagtgtaataagagcagtatatttttatgtcaaaagtaacctttctatagtactctttagataaaactgaatattggaaaagaaaaggaaagataagtagctcccttattcatcttagtccaaaatctattttgctcactgctggttgttggcattgtgtgatgatgtgacatagtaccagaggatcagattatcagaaaagaaaaggagattcccaatttaatagttactcactgaaattttccccttatctctatatcacagaaaaataagtagttgttaaatttcaaatcctgcagtctttctgatttatcatcaaatcgtggatgcacttagctgcctagcgtcagggaatccaataagtcctgtcacgt

SEQ ID NO: 2004 - DNA, 429 bp, Homo sapiens
attatatactattataatcatatattaatattaacatataattgtgtgtgttcaaaaatttttaatggcacaatcaaaaaactttaaagaccactggattaaaagatggtatttagggcccagcacaatgactcaagtctgtagtctcagcactttgggaagctgaggtgaggggatcgcttgagcccaggagatcaagaccagccatgggcaatatggcaaaaccccatctctacaaaaaatacaaaaattagccagatgtgttgcaactgtagtcccagctattcaagaaactgaagtgggaagatcacttgagcctgcaaggtcgacgctgcagtgagccatgattgcaccactccagcctgggagacagagcaaggccttgcttcaaaaaataaaaataaaagatgacattaagaagaaatctga

SEQ ID NO: 2005 - DNA, 364 bp, Homo sapiens
ctaaacatattgtatatgctttgttgaccatgtgtgtaccttttattcttatgtatctgttcaagtcttttacccatctagcatacttgggttgattggtttgttgttgttttgttgttgttgttgttgttgttgtccttgttgttttaattaccaggtaagaagatctcagcatactttatagttacagggtttgggggtcagataagtttcgtgactattttctccctgtctgaggctgtctcatttcttcactttctttgttgcctcttttgatgagaagatatggctaatatttgatgaagtctaatgtatcaagcctttcctttatacatttttttctgtgccctatttaataaatctc

SEQ ID NO: 2006 - DNA, 677 bp, Homo sapiens
aactgatcataatgtgtaaaaaggtgtaacgtataattagaaagacataagtaaaactcaattattgagccacaattctcatgaattaaactttaccatccacagttaagtccttattgcttgttaatcttgggtgcctgcactacacttgattttaaaattgttggtcttctataaattttcaagattttcctgagcagatacaaattcaggttttgatgtgcttcaaactaaggaacatcacctttcatgaaatgtttccagtagatgtgatgtgagtgaaaactttaaaaaatgtcatacttattgctacatttgaatagaaaataaaaggaataaagtatttttcctttgctacaaattaataatacgatcacatgcagagagaatgtgaggaaccttcaacactaaactttgatagtcacattatgtgaaatttgaaattttctgggtgacagtatacttattggtaggttttctggttcatgaaaataactcaagaactaatatttgtaattgtgaccttgttgtaattgggaaaggccactagttgatcatatgacctttattgaatatgtcatgcttgctgtttaaaaaattcctaactaatcacatgcaaattaatgctaaacaacttttttgtatttattaaaaatgatttaaatataaaaaaaaaa

SEQ ID NO: 2007 - DNA, 417 bp, Homo sapiens
cagagcagtgaaaacatcatttaaaaccctgcctaattttctgattgacccatgaactacaaacgtgggtcagattccaagcagtatctaggtgcatagagcatgagggaagcaaattgaataagtgaagaaagatgaacacctgcttggggctggggaggcatcccagtggcctttccagaggaaagtgtgaaggggcagtgggagaaaaggtgagatgcaaccacagcaacacccaagccaggcttgggagctgggtctgtctgctctgagaagccactgggggatctgggatggaggagtgtagaaggaaaccaagttttagaatgcagatccctctaagagtgggacttgttatcctgcctctaatttatcatttgtgcattttattgtaaaataaaatactaacttattgta

SEQ ID NO: 2008 - DNA, 264 bp, Homo sapiens
gaggtaacccccaagttatgcaacttttctgccaggaacaggcctatatggagaatattggaaaatttcaggctcagcatttatgttatttagctgtcgtgcctgtttcattactgtagagtaaattgtgacatacacctaggcacagttcacaggcatgataatgactctcatatgtggatcccacaaataggattaattttgactctcataactttctttagaaacacaagtgattaaatctctttctgttaaaaaaaaaaa

SEQ ID NO: 2009 - DNA, 255 bp, Homo sapiens
tgagacggagtctcgctctgtcgcccaggctggagcgcactggtgcaatctcagcttgctacaccctctacctcccgggtgtcaccatgttggccaggctggttttgaacttctgactcaagtgatctgcacacctcagcctttaaagtgctaggattacaagcatgagccaccacacctgctccttctatttcattttaacataaataagtaatagtagctaagacttactaagcactatgtattagacagttt

SEQ ID NO: 2010 - DNA, 1313 bp, Homo sapiens
tactaaaaatataagaatcggctgggcatggtggcgcacgcctgtggtcccagctgctcgggaggttgaggcaggagaatcatttgaacccgggaggcggaggttgcggtgagctgagatcgcgccactgcactccagcccggcgacagagcgagaatctgtctcaaaaaaaaaaaaaaaaaaaaagcattttccttccccaatttttctgtcattttcccatcctcattcaggcagagagaagaataacatgcccccttccaaaaaagacaaaacacaaggtagccacaaattccctagacacattagaaaaatagggagtggagaggggcattggaatgaaagttctctatctcattagctgttaggctttaggcatttatttggatggatccctttggcaccttggaagcaccactgaagtgctctgagaaaggggtcagctgtctgagggaatagttctggatagaggccacaggaagcactggccagttgctttagttctagatagctttgtattcccgccttgttgcccttagcggaggctggcccaaagcacacttgatcttgtccccactccctgcccccatctcagatcaaccttcagaaagtcccggcttgttggcaaaggcacacattctgtgttactcttaagtttcattagaaattcaagtcctctggggccctgttcccttgtgggcttgtgcaactgactttgtttcttgtctgcctttctggaaccaaatccaaggaaattcatgggtttggggagacagcgatgggaacccagcagggcacaggatgctaggataaagctgtggcgccccaaaagtggcctgctctgccaacatacataaatacatacagtctgagcttgacactgtataatttggcccagaacaatatgtattttgagctcatttaggtgaatgactttggcattccatgtacccactaggggaagctttatcaggctgcatttgccttatgcagaagtatgcctttgttctgagaaatggcctcagaacacactgttgagctgtctcctttagtgagtgtcatcctctcatccatttcaaaagattgcagatgccgtcttgaagtcctgcttgtaagaaatgcaggggttgggaatggaggagatgacgatgtagttttgcttttagttttcccaaacctgtttacattttttaaaaatgtaaccaacccataattgcattttacttgtcgtggttcgatctgattgtattgtcgaaggactatttttgaacctgtccaaataaactctgcaaagtatttccacaaaaaaaaaa

SEQ ID NO: 2011 - DNA, 415 bp, Homo sapiens
cacaacctttcagacttgaacggggccctcccctgctccgtgagcctcgccgtcctggtgcctggttctgccatagtaactttcaggtcctctaggaaccagatatttttgtccgtatagtctctaaatcctgctcacaggggatgttagtaattaaatgatgacttttacattgccttgcaccagcaaataaaatctgtagtctaagaacaaagcccggggggatgattcaccagcacccttgttagcagtgctgtgctcctcccccctttccttatccaccgtcatgcttcatagcttgtcacctgtgtctttctggggtgtggggtgggcatgtgtgtttggtgaatttttaggactcacctaaagggaagctttattgtcaatctctttccacaaatgagtgtaattgcag

SEQ ID NO: 2012 - DNA, 1659 bp, Homo sapiens
gcaggctggtactggtcccgaaggtccttatgatcaagcggccggtccgaggggacatggcggcaacctctgcagcgtcagtgctgctggcgggtgcaagaaactggtggcgacactgcctgagcccgctgctgttgccaaggtgacgaggcataaagccgcggtggatcggtgcgtgggggcgcggggtgggtggtgaagggagaacgaagctcgagcggaaagacaggaccgcgaccgcttgtcaggggattcggcttccagtcccccttccagagggcgtccttctgcagccaggcctctgtcttcccccgcccccacacgagtctcacttcatcaccatgctggagtgcagtggcactatctgagatcactgcaatctccgcctctcggattcaagcgattctcgtgcctcagcctcccgagtagtagctgggagtacaggcatgtgccaccatgcccagctaatttttgtatttttggtacagacctggtttcgccttgttggccaggctggtctcgagcttctgacctcaagtgatccgcctgcctcggccttccaaagtgctgggattacaggcgtgaaccactgagactggtcagttattggctctttttaaagattgtgttgctttctgcctcaatattaatatgttggaagttaccaagaagttcatgacagatctatttcaaattctggtgaagaaggaagaattggcccttgaaagaatcagtgttttacaataattttgaaagagggtagcgacagaaggaagaaaacattatcaggagggaattcagataaaggacaaaccatattttgactgctactgacttgttgaactggcagtcggggtcaacttgggaagacagctgtgaccataaatattaaagaagacaaaaggattctttgtgacactgagaccttctgcagtaccacagtggaggaaatgccagtgtacacaactggcctcatttaattcctgggaggagatagtttgggatgcagtgcttgttgttgctgagcaggcgatcacagcatgcactgtgtttctttctttgagaatatttgaatcctgcctgaatactcgtaacagatgagagacgcaggttttgatagcatagatttacgctgtcattagtcatgagctcttgggacgaaagtaattggttttatcctctttagagttagaccctgtggttgggtatgaaagatgagtgtctgtaaaaatccttcttagaaatgtatttcctcaagactctgtctcaaaaaaaaaaaaagaaatttatttcctagttctgtaaaaatcgctatattgagtgttctctatcacttaataatatacttattattaagtggacttaaagatatgcagtgtataaaatcagctaattacgttaaaccatggtatctccctttattgtgttagactgaatagaacaaactttaaaataattttttaaagaatatatttgaattcattttgtttgataatatgtttttattcagaaaagcattttattagcgctaggtgtgaacccgagccttttgctaaataccagcagcaatcatgtcctagagttaaatcccagaaaaattgccatattatatattaaaggttcaataaattacaataaagtattttttctttaaaatga

SEQ ID NO: 2013 - DNA, 915 bp, Homo sapiens
aacagccactgatgattaactagtagctcagattgttcagtggttcacgtagtacttgctgaataatattctgattcatatgttttcttttgttcagaactggcagtcggggtcaacttgggaagacagctgtgaccataaatattaaagaagacaaaaggattctttgtgacactgagaccttctgcagtaccacagtggaggaaatgccagtgtacacaactggcctcatttaattcctgggaggagatagtttgggatgcagtgcttgttgttgctgagcaggcgatcacagcatgcactgtgtttctttctttgagaatatttgaatcctgcctgaatactcgtaacagatgagagacgcaggttttgatagcatagatttacgctgtcattagtcatgagctcttgggacgaaagtaattggttttatcctctttagagttagaccctgtggttgggtatgaaagatgagtgtctgtaaaaatccttcttagaaatgtatttcctcaagactctgtctcaaaaaaaaaaaaagaaatttatttcctagttctgtaaaaatcgctatattgagtgttctctatcacttaataatatacttattattaagtggacttaaagatatgcagtgtataaaatcagctaattacgttaaaccatggtatctccctttattgtgttagactgaatagaacaaactttaaaataattttttaaagaatatatttgaattcattttgtttgataatatgtttttattcagaaaagcattttattagcgctaggtgtgaacccgagccttttgctaaataccagcagcaatcatgtcctagagttaaatcccagaaaaattgccatattatatattaaaggttcaataaattacaataaagtattttttctttaaaatga

SEQ ID NO: 2014 - DNA, 1602 bp, Homo sapiens
gcaggctggtactggtcccgaaggtccttatgatcaagcggccggtccgaggggacatggcggcaacctctgcagcgtcagtgctgctggcgggtgcaagaaactggtggcgacactgcctgagcccgctgctgttgccaaggtgacgaggcataaagccgcggtggatcggtgcgtgggggcgcggggtgggtggtgaagggagaacgaagctcgagcggaaagacaggaccgcgaccgcttgtcaggggattcggcttccagtcccccttccagagggcgtccttctgcagccaggcctctgtcttcccccgcccccacacgagtctcacttcatcaccatgctggagtgcagtggcactatctgagatcactgcaatctccgcctctcggattcaagcgattctcgtgcctcagcctcccgagtagtagctgggagtacaggcatgtgccaccatgcccagctaatttttgtatttttggtacagacctggtttcgccttgttggccaggctggtctcgagcttctgacctcaagtgatccgcctgcctcggccttccaaagtgctgggattacaggcgtgaaccactgagactggtcagttattggctctttttaaagattgtgttgctttctgcctcaatattaatatgttggaagttaccaagaagttcatgacagatctatttcaaattctggtgaagaaggaagaattggcccttgaaagaatcagtgttttacaataattttgaaagagggcgacagaaggaagctgacttgttgaactggcagtcggggtcaacttgggaagacagctgtgaccataaatattaaagaagacaaaaggattctttgtgacactgagaccttctgcagtaccacagtggaggaaatgccagtgtacacaactggcctcatttaattcctgggaggagatagtttgggatgcagtgcttgttgttgctgagcaggcgatcacagcatgcactgtgtttctttctttgagaatatttgaatcctgcctgaatactcgtaacagatgagagacgcaggttttgatagcatagatttacgctgtcattagtcatgagctcttgggacgaaagtaattggttttatcctctttagagttagaccctgtggttgggtatgaaagatgagtgtctgtaaaaatccttcttagaaatgtatttcctcaagactctgtctcaaaaaaaaaaaaagaaatttatttcctagttctgtaaaaatcgctatattgagtgttctctatcacttaataatatacttattattaagtggacttaaagatatgcagtgtataaaatcagctaattacgttaaaccatggtatctccctttattgtgttagactgaatagaacaaactttaaaataattttttaaagaatatatttgaattcattttgtttgataatatgtttttattcagaaaagcattttattagcgctaggtgtgaacccgagccttttgctaaataccagcagcaatcatgtcctagagttaaatcccagaaaaattgccatattatatattaaaggttcaataaattacaataaagtattttttctttaaaatga

SEQ ID NO: 2015 - DNA, 458 bp, Homo sapiens
gtttgccctgatggcgggctggccactatacctccctaggtaccttcaacttgacagccaaggacaagccaagaatgtacatcatttaccacgtgtacttgtatagcaaagcttatgaaatgcaacattttctacccaggacacttggtggaagtgaatctccagcactccacagtgaaaagaatctaggatgcagccagcagtgcttagtagagcccagagtcacacaccagccatccactcatgcatgccgggctggaaggcagacggctttaggtgggcacctgcccaggcccaccactccttgaccaccttcccaggggtggatttgagccccagataatccaaccctctcattttgcaaatgaggaaactaaggaaccacaagggagagagatttttcagaatctcacagcgagtttgcaacaaagccaggaccctggctcaggccttcagcc

SEQ ID NO: 2016 - DNA, 378 bp, Homo sapiens
ttttttgtagagatggggtctttccatgttgcccaggctggtctcaaacttctggcttcaagcattcctcctacctcagcctcctaaagtactgggattacagggatgagccactgtgcctagccttatattttagatcagtatgttattactattctactggttttgaaaactatagaaatacaaaatagtatggtttagtgaagggtttctttatcttggcactgttaacattttggcttgatgattctttgttgtggggggctgtcctgtgccttgtaggatgcttagcagcattcctgtcctctgcccattagatgtcagtagcgagcccccatcccccaccagctagggacaaacaaaaatgtctccagacat

SEQ ID NO: 2017 - DNA, 295 bp, Homo sapiens
aactatattcagtgagagcctcagtggtaagagtgaaagcatttccccccagtccaggggcttcatccttccttcagtgccttggccaggccctcagggaatgaggagacctttgctcttccctccaccttgtcctgactcctcaagcctccagccttgaggaggcttctctagatgaaagctcctcagtaattgtattagtctgttctcacaccgctatgaagaaaaacccaagactggggaatttataaaggaaagagatttaattgactcacagttccgcattgctggggag

SEQ ID NO: 2018 - DNA, 369 bp, Homo sapiens
gaacattttcattacgccccaagaaggcctgcacctgttagcagtccctccccatggtccgcactgccaaatctgaagtcataaagatttatttttatattttcttctaagagtttttttggtttcagcccttttaggtcttggacacttttttttttttaaggaaaatttaaactttagcttgggcatggtggctcacgcctgtaatcacagcactttaggaggctgaggtgggtggatcacctgaggtcaggagtaccagaccagcctggccaacgtggtgagtggtgaaaactcatctctactaaaaatataaaaattagctgggcatggtgccacgcacctgtaatcccagcggcaggggaggct

SEQ ID NO: 2019 - DNA, 154 bp, Homo sapiens
aaattaaaaaataacaaaaaatgagacagaaaacaaatattttgtttcattattgcttgttagttgattaaagtaattctgcttccactttattttcaaagacactaattgctacactgaataaaaccttaatggagtttcattataagtatct

SEQ ID NO: 2020 - DNA, 266 bp, Homo sapiens
tttttttttttttgaccgagtctcactctgttggtcaggctggagtaaagtgacacaatcccagttcactgcagcctcgacctcccaggctcaaatgatcctcccacctcagcctcccgagtacagggactactcacatgtgccaccacctccagctaatttttctctattttttgtggagacagggtctcactacattgcccaggctggtcctgaactctggggctcaagtgatcctcccgcctcaatgtcccaaagtgctggga

SEQ ID NO: 2021 - DNA, 402 bp, Homo sapiens
tgcaaaattgtgtagattaagtgatgtgcaaataaagcttttacaatagctaaaagcctggctcaacgtaaggacacaagaaaattgacagcagttctttgtgcagcgtgataccgttgacgtcctccttgtccaggccattctcttcctcacttaccctggagaggccggcactgactagtatcctacctggctgtcttcgcagcaggactaattggagaattatggacggagatcaaatatgctaggttctttaaatccagagcgcttacacgagtactgtacagattgagaccgtcatctcgcgctgtggtctgtctttgctttcatcccttctgtctaccacaccccctgctaataaccatcgccttatttagacaggatataaaacttttgatatgg

SEQ ID NO: 2022 - DNA, 387 bp, Homo sapiens
gactgctaaaatgtaaacatgtctgataagaatcttccaattgttcataagtttttcccttttctcttgtgtttactttttaattttaaaataacgatagcattgtgtatctactgacattgccgtgtaacaaatcatcccaacctaagtggcttaaaccaagaaccatttatgatttctcatgagtcagagtcagctggggatcagttgattaaatcttggcttaactggcagtgactctgctccatgtatttctcatcgtcctgctgtcagtctggataagtccttctcatggtgatggcagacagcaagttgagacacaacaaggcctcttgaagtctagcttgggactcgcataccatcatgtctaactcattttattggcca

SEQ ID NO: 2023 - DNA, 467 bp, Homo sapiens
atgggggcagatctatgatagatggcttggtgccattctggcaggatccagtgagttctcactcttagttcttgagagatctggctgtaaaaaagaacctggcaccttcctctcctctctttcttcctttctgtctggccatatgatgcctgctaccctttaccttccaccatgagtagaagtttcctggccgggcacggtggtcacgcctgtaatcctaacacttagaggccgaggcaggtggatcacctgaggtcacgagttcaagaccagcttggccaacctggtgaaaccctgtctgtactaaaaatacaaaaattagttgggcatggtggcgggcacctgtaatcccagctactcaggaggctgaggcaggagaattacttgaacccgggaggcagaggttgcagtgagccgagattgtgccattgcactccagcctgagcaacagagcgagactccatctg

SEQ ID NO: 2024 - DNA, 425 bp, Homo sapiens
gactgcaaacacccccagctcccagggcccagcagcctggagatcctgcgcacagaagcccagctgattttgaaaagccagccaagtggcttggcttcctgtttttgcagagtctttctcaatgtcttaaaatctaaaagttctccaaatgcagggatgccaggaggaggtgaacagagaggtatcgtggtaggttttatttttagatgctgaagtgtaaagtgtccagtttggcttcgttctggtccccagccaccacttcctcccccaagccaccacctaaatgaacagcatacatgtctagaaagatttcgcaatgcttcttctgccccggacattctgacacaatggctccagtctcctgttcctcccacagaccgagcggattaaagattttagtctaaatcttcccagaatgccacata

SEQ ID NO: 2025 - DNA, 485 bp, Homo sapiens
gtaagtagtcttgtgacggctcatattaactctcttatgcacaccagatagtaagactttgatatgatatgtactgcaggtatatgctataaagaaaaatcataacagcaaatattactccctggacccaccaacaagaagggtgttccttctctgctgctgccttgctgaacagttcaactttagcataagaactgctggctgagcgcggtggctcacgcctgttatcccagcactttgggaggccaagacaggcagatcacgaggtcaagagatcgaggccatcctggccaacatggtgaaatcctgtctctactaaaaatacaaaaattagctgggcgtggtgacatgtgcctgtagtcccagctacttgagaggcagaggcaggagaatcacttgagcctgcgaggcgaagattgcagtgagctgagacggtgccactgcactccagcctggcaacagagtgagactccgtctcaaaaaaa

SEQ ID NO: 2026 - DNA, 323 bp, Homo sapiens
gaatttaaattgtttgtgttgtaacagtgatacaaaaatgttcaatagctctttgaatgccactttttttaaagaaaatactttaaaagtcattcttagctaacctcaaaactcctttacattactttcattttagctcactcttaaagctgatactgttatatagggatgaagggagagttttcttaaagaaggtcccaaagttgaagatcgtttgtcattgatactctggccaagtccaggttttaggacaatttaatttactcttatttggatctgtaattatgggagtttatcacttttcctcttcaaagcacttcaac

SEQ ID NO: 2027 - DNA, 677 bp, Homo sapiens
gatgactagtgaatatgaggttttccattaggctggtaggaaacaggagctatttccagccccatgtgagctccaaggttctggttcctagccttggctactttccttacccatgtgtggttatcagtactcagttgaagacatgagtgggctctgcaggtctctgccatgctctttctgggcagctctttcctctctgccactctgccctgttgtaaactctagtcttcttggcctccctgggttgccaggtctgcctcttcaactaatggagaacacctcttctggctggctcccccgtcctggtgctgtggcctagcaagaaggtagggtaattatgaagtttccctcatttgtttccttctctcagggatcactgtcctgtactgcctgaagtccactgtttcaaagtcattgttttggccaggcacggtggctcacacctgtaatcccagcacaagttgggcagatcgcttgagcccaggagtttgagaccagcctgagcaagatggcaaaaccccatctctactaaaaatacaaaaatcggcctggcatggtggcacacacctgtgggaaacccagctacccaggaggctaaggaggatcttagctacccaggaggatcgattaagtccaggaagttgagtcggcagtgagctgtgatctcaccactgcac

SEQ ID NO: 2028 - DNA, 302 bp, Homo sapiens
gtataatgccctacaaaaaagcaggaagacctaatgattacaagttcactagttctaaccttattctttcctatacatatagtggtagtgaccaaggtagaatcttatatttttcttcatcttcaaatgttatcatttaaacccttgacattattgacttgagaataaatgtgaaaatcatggactgagcactctatactgtctgagtagtttatattttaagagtttcttaaagagtaacttgggaaatcagtccattaactactattgcagtgactgtggcacaagggtatattggtttt

SEQ ID NO: 2029 - DNA, 407 bp, Homo sapiens
attgaaaaaagtataacttttaatagaaaaataatctccttatttaatatgtatatttttaaatgttaatgaaataaaatgcttttctacttttggccttttatattaccagtcgacctctcttttccacggtcttctcatgtgtttaatgatgtcagtaactatcaaccttattgtgtgtttcaaggattgagttaatacagatgatgcgtttagaataatgcttgatgtaaacattcaatacattttagatcttatgtttggctaatctttttgatttactgatatattttcttatttcattttaaagttatttaaatttataatttatttattagagtcctttaggaatgttaacccttctcagtcacccgatgcaaatatttttcttgttggttatttgcctt

SEQ ID NO: 2030 - DNA, 444 bp, Homo sapiens
tctttctctttcttcctttctctctgtctctctctctctctctctatctctctttctttctttctttttcttcagggtctctgttgcccaggctgcatgcagtcatagttcactacagccttgaactcctgggctcaagcgatcttcctgcctcagcctcccgagtagctgggagtacaaagcatgtgccaccatgcctggctaactttttaaaaattattattatttgtagagatgggatcttgctatgttgcccaggctggtcttgaacacctggccacggcctccccaagtactggggttacagatgtgagccactgtgcctggacagttcttactttttaatgcattttttaattgattgtggtaaaaacaaaaaacccacaatatattctttttgattctgcgaagtgcagggtctctatcacagcaacaattagactc

SEQ ID NO: 2031 - DNA, 363 bp, Homo sapiens
taactaattatgaacatatggtttggcagacaccttgttagcttgctgctgcgtaggtgtttggaaggaggtgaaggggaaagtttgaggtagaaggtgtggctaaaagtcccactgataagcctgggggagatttgattgatcctaatctttttgtcaagaatcagcatgcttctggcagcaacagcttggtaataacagagatttgtggcccttaagctctggtgtgatagacggcacacataaccagatcagtcaactggctccttataaggccctcatttaattggccacaatagtgggaacagaaatgagatgttaggtcaaggtacaacacatggcctacctgaaatggctcaaaat

SEQ ID NO: 2032 - DNA, 349 bp, Homo sapiens
tttttttttagtagagacggggtttcactgtgttagccaggatggtctctatctcctgacctcgtgatccacctgactcggcctcccaaagtgctgggattacaggcgtgaccaccgtgcccggccaaatgcaatgagttcttgttctacttttagatcacttcaaaactctgtatttcatcctcacattgccttgtaagacagtaattataacactgaaaaattcctttttaaaccttattactctcccttacttatctcctggtaggcttcaagtacgaggagttcttaatctgtgatccatggaccatggtcccaaaggtctagggataaagctctgcttcagtag

SEQ ID NO: 2033 - DNA, 196 bp, Homo sapiens
acctatctgattggcaaaaattcaaaagcttgatagggagtctatctgagcctgggcaggttctggaagctgcccaatttaaaaaaaacaatggcgcctggtgcggcggctcacgcctgtaatctcagcactttgggaggccgaggcaggtggatcacgaggttaggagttcaagaccagcctgaccaacatggta

SEQ ID NO: 2034 - DNA, 881 bp, Homo sapiens
gtgagaagttaaaaatgtttcagatcgctgcctggggacacagtggaagattgccagaataaatgaccacctgtatatgggtaaaattgctatttaagagtgaaaaatgaaatagaaaacaacctattttaataagtgggaaaaggatgtgaatagacatgtcttcaaagatgatatacaagtggccaataataggaaaaaatgctcaacttcactaattatgtgggaaatgcaaatcaaaaccactgggtgatatccctttacatccattagaatggctacaattaaaaaaacagaataacaagtgttggcaaggatatagagaaactggaatccttgtgtattactagtgggaatgtaaaatggtgtagtcctatggaaaacaggatgatgatttctcaaaaattaaacataaaattaccatatgatccagcaactccacttctgggtagatacccacaagaattgaaagcaaggacccaaacagctgtttgtacactcttgttcatagcagcactattcacaatatccaaaaagtggaattgtccattgaccaatgaattggtaaacaaaatgtggtctatacatacaatgaaatattattcagccttaaaaaggaagaggaattatgaaacatgttgcagtgcggatgaatcttatcatgatgctaagtgaataagccagacacaaaaaatccaaatgtatcattctacctgtatgaggtactttaagtagtcaattcatagagacagaataagattgtggctgccagagaatgagggatgggggaaaagggaaattgtttaatggatacagcatttcagttttgcaagatgtaaaagttttggagatccattgcacaacagggtgaatacaggtag

SEQ ID NO: 2035 - DNA, 365 bp, Homo sapiens
gtaactttatacatgcgaaattttggtaaaattgacaaatccatagaaaaattcgacttgcaataataaaaaacaaacccctgaagtgtcttaaaactgttaaaaaggaattgaacctccaaattaaaatattttcattatgtaatctccaggcccagatagcttcactactaaattctaccagtcaatcacttaataaatggacagtgtcacgattccagagaatacaggagaaagcttactcagcttattttgtgacaccagcagtagtcttgatactaaaattcaacaaggacattagaaaaatgaaaattatataatgattcttgtgttacctttcaaaaataaaggaaaaatcagccggg

SEQ ID NO: 2036 - DNA, 442 bp, Homo sapiens
ccactcgatttctctcagtctcacctgtccttgggacctacgaccacttgggctgctccagtggacattttctcaaggactccagtcaacttcagaagagcacaattccataaccccttggcctctcgtcctactgcacttcttccaccccctccccggggcattcctaatgatggggagccacaactctactgtgagatattctagggtgcctagcacagccccaaagtgtggaagttcatgccctgtgagtgaatctgtgaccaataagagatgtcccctttcttccagggacagactgccttgggatgccatatacagcacccctctgaagttaagcctttgagattaagcagtcagctgtgcttgacaccaagcatccctccttttctgcctcacccctctttttgctcactcttacttccctgggattgtactcctt

SEQ ID NO: 2037 - DNA, 489 bp, Homo sapiens
ttcttttccaggtgaagcccttggactactgtggccaagtgaacagtgccctgtttagacaacccaggcccatttctggcttttccaccaaataattatgtgacacaaggcaatctgttcgcttccctggaccttagttcctcctctgtaaaatgggggaaatgatgtcataagtccctctgagctctaacttcctccatgtcttccccacatagccagttctcactttttttccgtatgtgtattatatggtcagttttaaatctggaacagtcttcttttcatgtggctgttttttacaagtagatctttaagaagacaactcagctgccaagaatcatgttgtctcctaacaaacaatatccattattctgggaatattgattatccatcatttcaacaacccagtatctctttccatcattagtgctgatgactgggtgctgcctgaattacacaaccactttcctatccctccagcctcctcta

SEQ ID NO: 2038 - DNA, 502 bp, Homo sapiens
gccactgcatctggccccaaatttttaaaaatcctctttaggatgaaaaatgatcccctctgaaataagtttcctatttagctaatgaatgttgagtgctattccagataaaagcatggagaaaaacagtttccataaggtagtaaacactaacggtccctacggcctcgagggagggggagtacgctacgaacattcatagaaatatgtttctttaatagatctcaaacaacactttcagggtggtccatctaaacataggttgtgtttaatataaaatgactgcaagcagagcctgtcaatgcaagacacattgctacatctgtcacataaaatagaaaaacaagctgtacagcagaggacctgtccatggacctcccaggctcaagcgatcctcccggcttagcctcctgagtagctgggactacaggcacataccaccgtgcctggttaattttttaagttttgttgttgttgttgttgctgttgtttagacagagtc

SEQ ID NO: 2039 - DNA, 316 bp, Homo sapiens
tccctttattcttaccctccagggttaactactataactgtctgctgaatggtatgtcagattttacttacatatgtattaatatgtaactgaagaagagttttgttttaacaaagttcagtgtcctattagacattaatgtgtgtattagttttctgtgactgttgtaacaaatcaccacaaactgggtggtttaaaacaacagaaatgtattctgcaagccagaagttcaaaatcaaggtgtcggcagggtcatgcctctgaggttttaagagggaatgtgttccagccctcttttctagtttctaatggcttc

SEQ ID NO: 2040 - DNA, 304 bp, Homo sapiens
gaatttgctttctcaagctcagtcagtggcagaagtggggcatgagacaggccttaacttctcctttcattgcagagccatatgtgatttaatatggcagggcattcaaggaaacccaagtgacttggattccaagttatttggaatatttctgtcctgttgtttttggtctgctttctaaaccacacggttgtgatcttcttccttcgatagtacattttaactcttcttattgaaattgaaggacacatggattccttgctccccccatgtcatgtgcatgtcagatttaatcaggttatct

SEQ ID NO: 2041 - DNA, 391 bp, Homo sapiens
acactcgacccagtctaaagtgggtgccattcacggaggaagagggaggttggagacttcaaccgggcaaaggagcacaaggaaaccaagcagcagaggccccatcagcacagagggcctcgttccacgaacgtagagtttgactgcctaagggacagcacgaatgactcacatgtttcagacaggcctccacggctatggagagaaggctggaggagacacaatggatggttcatgttctggcttagcaagagccaccaagaactttgggtgaagcaagcagatgacaatgaagaggagtaatgttccgaatcatgtttttgaaaaatcaagacctcctgttaagggcccacttgaccctagaataaggcaggagagtgtctaaaatcta

SEQ ID NO: 2042 - DNA, 443 bp, Homo sapiens
gtccaaacagattgttttttccttctgtttggcaacctcaatggctctacctgtttctggctgtcatacttcggcttgtgaacagccttcctccctaattttcaggaaactaacaaattaaaggtgcaaatgtcaggtggttactacatatctactggctcacataattcaaaacagagtcatgcagctcctatctaaagctagttccttgccccttctcagtcactaccacatcaagcacaaatgtagatgaaagggtagtgtgtcaaggtgagagctgcccactgggtagtgttactcggtcacttgctataggggacagattagctgccaatcagtatctcatcactgtcattggcgtttataatccaggttcctagccccactggtgatctatttctgtgcctccgcagtgacgccagttgtcctagcaacgtgctggc

SEQ ID NO: 2043 - DNA, 434 bp, Homo sapiens
ccctctctctaaaataaatgaatgagtaaatgaagatgtattctgatttaaccaagctggtacctcctagtgactgtatttggtagagaattacagttttgagaaggttgggctctattgtgtgtgagtcatcagcaccttaaaagtgataagaaaggatagccaggcatggtggctcatgcctgtaattccagcattttgggaggccaaggcaggcagatcccttgagccatggagttcgagaccagcctgggcaacacggcgaaaccccgtctctaaaaaatacaaaaattagctggacatggtggtgtgtgcctgtagtcccagctacctgggaggctgaggtgggaggatcacttgagcccaggaggtcaaggctgaaatgagccataattgtgccactgcactgcagcatgggcaacagagcctgtctc

SEQ ID NO: 2044 - DNA, 179 bp, Homo sapiens
ggtgattaaaacttcagaactgtttttgaatactaatttggtttttggaaacagcccaactccattcgggaaaatctggggaagagggaatcaaatctgggcaagctgggtgacagtattttagtttaaaaaacaaaacaacaaccttcctctctcccccacctcaaaaaaacacaaca

SEQ ID NO: 2045 - DNA, 299 bp, Homo sapiens
ccccatcattttttgagaattttctttctttcttgtgaaacaagatgtttcaggttcatcttatcctttctttgcctggaatcagccttttttccaaggaatctgggtcccttttaatggagaaaggtatttagaaattataatctgggttctgttcacacttagtgctactggtatattattgtttctaggctttcttggagacagagatagattatgtacatatataatagaaagatgattaatatatacgtagtaaaatcatgtgttctagagggcacacttttttctcccctttt

SEQ ID NO: 2046 - DNA, 471 bp, Homo sapiens
aaaagttaataaacttctgggctgtacatggttattaaatacatgtacaagagtattaattctagcccttgaaaaatttaaggaaggatatgatcccatttagggtgggaatgaaacaagagagactctgtatcccttcaaatattgtagctacatagcttgcatctggttctgttatcatactgatcggattctgatttcttgtgaagtagaaatagtggtagcagcagcagcaaccatgtttcaagtacttgccatgtacttatgcaatgtaacctacccacacagtaagcacttaaaacttttcatgtattagctcatttaatatgcacagcaacctgatgaaatatacactgttgtgacaaatctgagcctcagtttccttatttgtaaaatgaggaaatactccttggaagaaacttactgtaaggaaaacattccttgtgtacggataacgagtgaacctctaga

SEQ ID NO: 2047 - DNA, 374 bp, Homo sapiens
tcgcttgaacctgagaggtggaggttgcagtttgcaatgagccgaggtcatgccactgcactccagctgggcgacagagtgagactccatcttgaaaaaaaaaatgactttcttaaagtcctcaataatcaaggaatagaagcaaagtagaatatagacatacacagtgaagtgactataagatgatgtcttcaggagaaaacagagaattaagccaaaatggaaagtatttctgggaatagctgcagctgaatccctaagaaattgtgccattttaaagctagaaggcaaattgggaagacactgaggccaaatccatcattttctattagggaagtgaggaacccaagtcacaaagctagtgatggcagaga

SEQ ID NO: 2048 - DNA, 405 bp, Homo sapiens
ttgtatttagtagagacatcgtttcattatgtaggccaggctgttctcgaactcctgacctcaagtgatctgcctgccttggtgtccagcagtgttgggattacagacatgagccacagcacctggtccatttctggtagaaaattttcaaaataaaaaataatggcatcgattttagggagtccctttagtgttcccccagcacgtttatggtgtgaactgagaatggaggctgtctggggccacaggacactctcattctcattgctttagggtggtaagtgacaagaaatttttcctcaaagaggtagagcttggctttcaggatcctcagtggcagtgtccggtggttctgggattcagtggaatgaaggatgaaaattaataagccagtggtctccttga

SEQ ID NO: 2049 - DNA, 383 bp, Homo sapiens
caactcctgctccctgctctattccaactgcttcccccaggaaggggggacgaggcggaggaagtcgttctcttgacacccctagaacataaggcatcttggccaggcacagtggctcacgcctgtcatcccagcactttgggaggctgaggagggtggatcacctggggtcaggagttcaagaccagcctggccaacgtggtgaaaccccatctctactaaaaatgcaaaacttagccgggcgcggtggcacgtgcctgtaatcccagctactcgggaggctgagggaggagaatcgcttgaacctgggaggtggaggttgcagtgagctgagatcacgccactgcactccagcctgcacaatggagtgagactctgtctca

SEQ ID NO: 2050 - DNA, 470 bp, Homo sapiens
gtcactacttctcttctgcttgtttgtgggtgaggggctgaattatattttactgtatgtctctaccataatttggtcatcctttcatccattgatggacaaggatgggctgtttctaccttctctggctattttgaatagtgctgctgtggacctgcgtgtacgtgcatttgtttgagtacctgtttttttaagaatataatcttagagcattgcttaaggatggacttggggttatctgtatctgggtccttgctactcagagagcgatctggagagcagctgcatgagcatcgccaagcagctggttagaaatgaccattgcagacccaccccagacctattgagttagactctgcacaggtgaatcagatgcatattaaaatttgaggagtagtgatctagtcagtctttggactggctgttttttaatgtatttattttaattaggaaatgtaattttcatatat

SEQ ID NO: 2051 - DNA, 454 bp, Homo sapiens
gaaatgttgtctaaagagtgaaagcagaagaacaatgttccaccaaatagagaatatcaatagataccaaaatcaggtatctctattagaggctgggtgcagttgctcacacctataatcccaacactttgggaggctgaggtgggaggattgcttaagctcaggactttgggacaagcctgagcaacatatacccccatctctacaaaagttttaaaaattagttgggcatggtggcacattcctgtagtcccaactactcaggaagcacttgagcccagagactgaagctacagtgagctatgatcatgtcactgcactgtagactgggtgacagagtgagaccctgtctcaaaaaatcaaaaacagaaatccagtaacagcaaaaaacactaaatagaagttttgagttagaacttcactagaggggctcagcagcagatgtgaactggca

SEQ ID NO: 2052 - DNA, 426 bp, Homo sapiens
gcatgcgccaccatgcctggctaatgtcgtatttttggtagagatgggatttctccatgttggtcaggctggtctccaactcccaacctcaggtgatctgcctgcctcggtctcccaaagtgctgagattacaggcatgagccactgcactgggcctgcttctatttttctcactgacttggttgcattcagtgccagtaattccagtggtcacatatccatgttgtctttcgtgcctgttctaccagttggcattgctccctggaagggacttggtctacaactggcagaactccttctcctaaggccttgtgtaaggtcactgggatagaccatggccctgatggttgatattgcctccccttgccataccttacctgggaaagtgaggcccaggagaagggaaaatgggtgtagaacagatgt

SEQ ID NO: 2053 - DNA, 625 bp, Homo sapiens
cgtggtcattacaaggcaaatgtattccattaaagtacatgcatacatatattttagagaactcaatctggtatgcgttatattcagagtagagggtatatgtcaccactgtgagcctcatgcctcctagagatcacatcttggttcaataaccactggtgtcctggcaccccattttatctcattatagttgacagtgcgctccctgcaaagatctcatgtagttccaaaatctctgaacagcaacaacaatattcagattaggaaatgtaaggaaacaggccagggtgtggtggctcacgcaaataaatcccaacacgttgggagggccgaggtggaagaacttgcttgaggaccaggagttggagaccagtgtgggtaacaagacaagacactatctctacaaaaaatacaaaaattagctgggtggggtattgcgcacctgtagtctcagctactccagaggctgaggtaggagaatcgcctgagcccaggagatggaggctgcaatgggccaagatcgcaccactgtgctccagtctgggcaacagagcaagaccctgtctcaaaaaaaaagatgaaatgttaaatatatataaaaagaatgtaggccaggcacggtggc

SEQ ID NO: 2054 - DNA, 532 bp, Homo sapiens
tgtatgtactatgttttttcctttgcagtcatttcatatagggcaggtagcgagaccatgtagatatgctggaccaagggctgactcatgtcccagatcaaacagagtgggagggtgagagatttcaccatgctactcagaatggcatgcaattgagcacttatgaattgtttgtggaattttccatctaatattttcagaccatgtggttgactgtggataaggagggactgctgtagtgtctttgcagatgttatcaagtaaggatgaggtcctactgggtcagagtgggccttcaatccaatggctggtgtccttacaaggggcaagaaatttggagatacctacacatgcacgaagggaagaaggccattaacagtggagacagagatggaagtgatgcagctacaagccaaggacaccagggctcaccagcaccactggaagctggaagagttgagagctgattcttcccctggggctcagagggaacatggcccccgcgcttccagtctccacaacagggagagaa

SEQ ID NO: 2055 - DNA, 244 bp, Homo sapiens
cctcttaccccactcccagaatagacaaatgctgagggaaaagcagctgcagaatgctggctcacctccttgtgcagttccctttctccctggttttatctcctggagtccttgtctcagcagctctctagtgatttcaaacttttttttacttttattaagcgtttctagttgttcttgttggaaatgttggtcatcctcaagctacttcatcatgactgaaagaatacttttatagttcttt

SEQ ID NO: 2056 - DNA, 275 bp, Homo sapiens
ggaagacagttattttgaaaaagcaacactcaaatgtctgtctgctacacattcacagttgacaggagggagaaatgtttctacgtagatatattgagtgattaaaaaatatatttacatgttaaaaactggatattaaccttaagtctaaatatgcacattatcatacatatgtattataaatcttacaggtaacctctaagaaatagttgtaaatgaggaacaatgcaattgactacaattctataatatcctccacataatgcatacattta

SEQ ID NO: 2057 - DNA, 453 bp, Homo sapiens
agcgatctcagctcactgcaacctctgcctcctgggttcaagtgattctcctgccttagcctcccgagtagctgggattacagatgcatgccaccacgccctttgtatttttagtagatatggggtttctccatgttgatcaggctgggttcgaactactgacctcgtgaaccgccctcctcgacctcccaaagtgctgggattataggcgtgagccaccgtgcccagaccaaagtttgctttcttttgcttgcatagcagtggtgctgtttcaccttgcatggtggcccagttaagggttacttgtcccagccttcattgtagccaggtgtagccatggagggcaccgtccgtccagtgaaaaatgaacagtgatgaggcatggcatttctgggtacgggccttctaacaccaagtgtgggctactctgtgctctttctcctccatggagta

SEQ ID NO: 2058 - DNA, 403 bp, Homo sapiens
agattctgtccagaagtaacatttagagcataggcttccatttcattggccaaagcaaaccatacttacttttgagaagtggaggtggagaaacacaacctcataacatgtgtgaaagaaataggaaaactggcatatttgtaaataaatctaacgacttccacaactgttctgctatagtgcctttcttattaccttgcctttctctgaagccactacagaaacatcaaaaagaattatggaaaaggtcttgagtatacaaagaatgtagaataaaagactgtgaaataaagtattgacagatatcatacattagatggaaaagagatctaaaatacagatgaattgcttatggtaaacttataaaagaaatcacaaattattgaagattttttttaatcta

SEQ ID NO: 2059 - DNA, 7557 bp, Homo sapiens
  misc_feature (2152)..(2152): n is a, c, g, or t
  misc_feature (2303)..(2303): n is a, c, g, or t
  misc_feature (2530)..(2530): n is a, c, g, or t
  misc_feature (4348)..(4348): n is a, c, g, or t
  misc_feature (4592)..(4592): n is a, c, g, or t
  misc_feature (4679)..(4679): n is a, c, g, or t
  misc_feature (4685)..(4685): n is a, c, g, or t
  misc_feature (5029)..(5029): n is a, c, g, or t
ttctgcttatcatggttaccaacaaaatgactgctgcctttagaaaccctagtgggaaacaggtggcgacagacaaagttgcagaaaagctgagctctactctctcatgggtgaagaacacagtatcgcatacagtcagtcagatggccagtcaggtggcaagtccatctacttcattacataccacatcctcatctaccacactatcaacaccagccctttcaccatcttccccatcacagttgagtccagacgtcttagaactcctggctaaactggaagaacagaatatattgttagaaacggatagtaagtctttaagatctgtaaatgggtcaagaagaaacagtggctcttctcttgtgtcgagttcatcagcctctagcaacctcagtcaccttgaagaagattcttggattctttggggaagaattgttaatgaatgggaagatgtacgcaaaaagaaggaaaagcaagttaaggaacttgttcataaagggataccccatcactttagagcaatagtttggcaacttttatgcagtgcacaaagtatgccaattaaggatcagtattcagaactcctgaaaatgacctcgccttgtgaaaaattgatccgaagggacattgctagaacttaccctgaacacaacttttttaaggaaaaagatagccttggacaggaggttttatttaatgtaatgaaggcttactctttagtagatcgtgaggttggttactgtcaaggaagtgcttttatagttggattgttgcttatgcagatgccagaagaagaagctttctgtgtatttgttaaattaatgcaagattatagacttcgtgaactttttaaaccaagtatggcagaattgggcctttgtatgtaccagtttgaatgtatgatacaggagcatcttccagagctctttgtacattttcaatctcagagttttcatacctcaatgtatgcatcatcctggtttctgactatctttcttacaacttttccactaccagttgcaacaaggatatttgatatctttatgtctgagggtttagaaatagtgtttcgtgtaggattagcacttcttcagatgaatcaggcagaactgatgcaacttgacatggaagggatgttacagcactttcaaaaggtcattccacatcagtttgatggtgtcccagacaagctaatccaagcagcttaccaagtccaatacaattcaaaaaaaatgaaaaagcttgaaaaggaatacactacaataaaaacgaaagaaatggaagagcaagttgaaattaaaaggttacgcacagaaaatagacttttaaaacagcgcatcgagacattagaaaaacataaatgcagttccaactacaacgaagattttgtgctacagctagagaaggaattggtccaagcccgactgagtgaagctgagtctcagtgtgcattaaaagagatgcaggataaagtcttggatatagagaagaggaataactcccttcctgatgagaataatattgcaaggcttcaggaagaactcattgctgtgaaacttagagaagcagaagccattatgggtttgaaagaacttagacagcaagtcaaggatttagaggaacactggcagcgccacttagctcgtactactgggagatggaaagacccacccaagaaaaatgctatgaatgagttacaggatgaactgatgaccattcgacttagagaagctgaaacacaagcagaaataagagaaataaaacaaaggatgatggaaatggaaacacagaaccagatcaatagtaaccatcttcgaagagcagaacaagaggtgattagcctacaggagaaagtgcagtatctttctgcacagaacaaaggactccttactcaattaagtgaagcaaagcgtaaacaagcagagattgaatgcaagaataaggaagaagtgatggctgtgaggcttcgggaagcagatagcatagctgctgtggctgaactacgacaacacattgctgagcttgaaatccagaaagaagaaggaaagcttcaaggacagcttaacaagtctgattctaaccagtatattggggaactgaaagatcagatagcagagctgaatcatgagctcaggtgcctaaaaggccagangggcttctcaggccaacctccttttgatggaatccacattgtcaaccatttaataggagatgatgaatcattccattcctccgatgaagattttatagataattccttacaggaaactggtgttggttttcctttgcacggaaaatctggntcgatgtctttggaccccgcagtggcagatggtagtgagagcgaaacagaagacagtgtgctggagaccagagagagcaaccaagtggttcaaaaggagcggcccccgagaagaagagagtcgtattcaaccactgtctgaccatcactgtgacctagactatggatttatttaagggatcagttatcatatgattagggctttttggaaataatttgtttcatatntatatatatatatatatatatatattttacagtcttatctgcctttttatctttgccaaatctttaccactgatttaccattgccataaagtagactggtatatggttaatgtgtaaaacaaggttctaacagtattactgaatattaatgtttcttgtttagaaaatgcaactatatctatatgtgggaaccattctgaagttcaaaactatggaaaattgaattttcttcagacaaaactgctcttgtgcaatattttatgctcagtgagcaaattgtgtatttatgtttatcaatttgttctcaaggtggctgtctacagacatttgaccaagacatacatctgatttaccttgtgtttttttttttattggtgtttttttttttaagacagagattcagtctgtcacccaggctggagtgctgtggtgtgatcttagctcactgcaacctccgcctcccaggttcaagcaattttcctgcctcagcctcccgagtacctgggactatatgtgcgcaccaccacgcctggctaattttttgtatttttagtagagatggggtttcaccatgttggctgggctggtctcgaactcctaacctcaagtgatccacccgcctcagcctcccaaagtgctgggattacaggtgtgagccactgcacccagcctaccttgtctgtttgtgtctgggaggttttttttttctatttttattttttcatgaaaattattggtgggccactgaaagtccccacacacaaagcctttattctatataattttataaacacaaattcatgattatctgttttgagagttttaagttttgttttaatgtttaacttttatgtgcatatgatgcttccatgtgttggttactagagtagtaggttaactacagacatactgttttgtttgtacatatttataaatctgtaccacctaacattgaacatcattttatatgaagaacatacatgttgcaaaatgactgctttcagcatctaacaggacttctgtaaataataggttaaaagttaaaaataaaacactaatgttttaagagctttagtattttgcttagcattcaatactagcagattcataactgatgcctgttcaaaaacactgttggtggaatcttttatttcatgtgtatgtaactactaaatttttcatgactgaagaggttatagcacatattagttagtgctaatattctactgaatataatttaagcaatgggctaaggtccaagaaacatagcaattatatctacaaataatctattaacatgatcttcagaatctctagtttttgttctatagataaagccataagaatcctttcctaccagtttttcctatatcatttagatattatttcctagaaaacaggatgcctgtcactgataagttagagaaaacacccaaattatacttgcactatggaaagacgacatgaatatgttgactgggtactttctactctcatttttgttagcctatgaaaaaaaaaacattttgttaacctatggaaaaagccttggaagagaaaagtagaattcagtatgtatggaggcacagttttgcacagtatgttgcatgcggcaaaaaaaaaaatatgaaatagagtagaagagataaaagtagttttctgtcaaaaactaggagttaagccttcaggtacgttgtggactaggctttccagcaaggtttttgtagctatttgcttgcctgagaaatgaaattgaaaacatacccctgcgtgtctgtccttaacaccaggctaaattctggtggttaaataacttanctgtggttacaagctagtaagtagcagagccaagattttttttaatatagagacaggtgtctcactgtgttgtccaggctggtcttgaactcctggcctcaagtggtcctcctgcctcagcctcccaaagtgtggggattacaggtgcgagctactgctcccagcaagagccaagattttaacctagatctccctaacaccaaagcttttgaaagggttcagctgaagaatttctcaattcttntgttttgtttttatttttgttttttgagatgaagtctcactgcactcaggctggagtgcagtggtacgatcttggctcactgcaacntccacntcccgggttcaagcgattctcctgcctcagctcccaagtagctgggactacaggtgcacgccaccacaactggctaatttttgtatttttagtagagatggggtttcgctatgttggccaggctgatctcaaacttctgacctcaggtgatccacccactttgacctcccaaagtgctgggattactagacgtaagccaccacacctggcaattccctgcttttttgacaacataatttaaatgaatttgatttaaatgtttcctgaatatatatacagatagatagatgagtatcaacacttacaagctctacacagtctgtgagtgtagatactacttactngtaggattgtcttgtgctttggggatttttgttcggagttctatactatcagcccagaaagctatcaatgtccaagtgaagtgagatgatgcatggccacattattgctttgaccctcacatcaagaaatctgaatgatctggaccaggggtcagcaaagtgcagcctacaagctattgcagtcagctgccagtttttacttttttaaatagttgggaaaaaaattccaaagactgatattttgtgtcacatgaaaattatatgaaattcaaattgcagtgtccataagtaaagttttattggggcacacccatgctcacccttttaaatattgtgtatggccgctttgtgctacagtagcagagttgagtcattgcaagggagaccatatggcccaggtagcctaaaatatttatctgatcctttacagaaaaagtttgctaacccttgataacagatactctaaaatgcaggtttttcttcttcaatttagctcagtggtaggtcaaattgtttgcttttgctattaagcttatgatttggaaacgtaaaatttcatggtggatcttataatcagaactattcaaaagggaaaacatgccagccattttatatgatgaagtctcttattccatagaaaactgtagaaagatatctgtatctttggagaaggagaaagaaaggaaagaactccagaatcccatcactgttctttaaagcatgcatcacagacctttaagagtatgctttattgagtaaaggttatagtttgactttaagataagaaattttctagaatcatgtttgaattctaaacgttgatattcttaagtaccatttctgattaggaattaggtgttaaaagaatcatggtaaggaaaccttaatccgttgaaactcttgtaatttggacaacaaaaaactagaaataacactcttttctttgaagatctgattcaaatacaccttagaagagtttaaaatctcccaggcctttaggatgcaataggatattatgccttggtttgactccttttcattcaaattaatgtaagtatgttgttcaagactttgaagcattgaacaatgttctcgacgaattttatttaattactgacattttgtgatatttgaatgttattaagttaaacacttagagttgagtatattcaggggagaaaagtgaatgaaatgactcataataagaaagcttgctcccttgggacagttaccttcctggtgtcattgccatcctgggttgacaagctgagagtagaggatacaagtgatgtgaataaaatggaaattgcattgagttaatgaaacagacacttttagatcaagaaaacacttcaacagcctttttagaaattggcacactcctatagtcccacctactcaagaggctgaggcaggaggatcactagagtacaggagtttggggctgtagtgtgtaatgatcacacctgtgaaagaataaccactgcactccaacctgggcaacatggcaagaccctgtctctttaaaaaaaaaaaaaaatcctgggaaaagaagtcaaagatgtaattttacacaatttctgcccccaccgtcttttttgtttgtttgtttgtttgtttgttttttggctagatactaggtattcagtgtttgctgagatgacaggtttctactaatcagccagttatttgggaaggagaaaaactttttctcaattctgaacatgatgcagcttgttaactctccagatagtgcctttgattgaaaataaggtctacacctttttaagtatattatttctgacatcgtaagaaataatttagttccttattctcatttatcttttatataatgtactgtaatattcaggtttaaagtaaaataagtatatgaattatattttggtaaaactgtttcatgaccagcttgattaatgtatattaacataccagacattgacagcgaacatttcatgaaatcagttatttacttactaaaacaatgagttttagcttgaaagttactgctgctctattattaacaaaactaagttttaaaaattaattttaattctactgaagtttaatttctggttaaaggtatagtggatgctatttatgatccaagtttttacatcacatccattgatctgcctatcccttctttttactccaaagaggagatgatagaataatacattcagtatactaccaagaagcaaagttataatgtgtttcattttgctattggaattttttattgtaacattgtatgataacctgaaatgtttacttgtgccttttctttaaacaattaaagttttccattttataagaaaaaaaaaaaaaaacaaaaaccccgacaaaaacaacaaccagcaacaccacacaaaaaacacacgccagcacacaagacgacacaccacacaaacaaaaaagggggggccaaaaccacgaggaaccacacaccctttatggggccaagagtaataaaaggggggaaaccagagaagacgctggagacctgt

SEQ ID NO: 2060 - DNA, 7503 bp, Homo sapiens
  misc_feature (2152)..(2152): n is a, c, g, or t
  misc_feature (2303)..(2303): n is a, c, g, or t
  misc_feature (2530)..(2530): n is a, c, g, or t
  misc_feature (4348)..(4348): n is a, c, g, or t
  misc_feature (4592)..(4592): n is a, c, g, or t
  misc_feature (4679)..(4679): n is a, c, g, or t
  misc_feature (4685)..(4685): n is a, c, g, or t
  misc_feature (5029)..(5029): n is a, c, g, or t
ttctgcttatcatggttaccaacaaaatgactgctgcctttagaaaccctagtgggaaacaggtggcgacagacaaagttgcagaaaagctgagctctactctctcatgggtgaagaacacagtatcgcatacagtcagtcagatggccagtcaggtggcaagtccatctacttcattacataccacatcctcatctaccacactatcaacaccagccctttcaccatcttccccatcacagttgagtccagacgtcttagaactcctggctaaactggaagaacagaatatattgttagaaacggatagtaagtctttaagatctgtaaatgggtcaagaagaaacagtggctcttctcttgtgtcgagttcatcagcctctagcaacctcagtcaccttgaagaagattcttggattctttggggaagaattgttaatgaatgggaagatgtacgcaaaaagaaggaaaagcaagttaaggaacttgttcataaagggataccccatcactttagagcaatagtttggcaacttttatgcagtgcacaaagtatgccaattaaggatcagtattcagaactcctgaaaatgacctcgccttgtgaaaaattgatccgaagggacattgctagaacttaccctgaacacaacttttttaaggaaaaagatagccttggacaggaggttttatttaatgtaatgaaggcttactctttagtagatcgtgaggttggttactgtcaaggaagtgcttttatagttggattgttgcttatgcagatgccagaagaagaagctttctgtgtatttgttaaattaatgcaagattatagacttcgtgaactttttaaaccaagtatggcagaattgggcctttgtatgtaccagtttgaatgtatgatacaggagcatcttccagagctctttgtacattttcaatctcagagttttcatacctcaatgtatgcatcatcctggtttctgactatctttcttacaacttttccactaccagttgcaacaaggatatttgatatctttatgtctgagggtttagaaatagtgtttcgtgtaggattagcacttcttcagatgaatcaggcagaactgatgcaacttgacatggaagggatgttacagcactttcaaaaggtcattccacatcagtttgatggtgtcccagacaagctaatccaagcagcttaccaagtccaatacaattcaaaaaaaatgaaaaagcttgaaaaggaatacactacaataaaaacgaaagaaatggaagagcaagttgaaattaaaaggttacgcacagaaaatagacttttaaaacagcgcatcgagacattagaaaaacataaatgcagttccaactacaacgaagattttgtgctacagctagagaaggaattggtccaagcccgactgagtgaagctgagtctcagtgtgcattaaaagagatgcaggataaagtcttggatatagagaagaggaataactcccttcctgatgagaataatattgcaaggcttcaggaagaactcattgctgtgaaacttagagaagcagaagccattatgggtttgaaagaacttagacagcaagtcaaggatttagaggaacactggcagcgccacttagctcgtactactgggagatggaaagacccacccaagaaaaatgctatgaatgagttacaggatgaactgatgaccattcgacttagagaagctgaaacacaagcagaaataagagaaataaaacaaaggatgatggaaatggaaacacagaaccagatcaatagtaaccatcttcgaagagcagaacaagaggtgattagcctacaggagaaagtgcagtatctttctgcacagaacaaaggactccttactcaattaagtgaagcaaagcgtaaacaagcagagattgaatgcaagaataaggaagaagtgatggctgtgaggcttcgggaagcagatagcatagctgctgtggctgaactacgacaacacattgctgagcttgaaatccagaaagaagaaggaaagcttcaaggacagcttaacaagtctgattctaaccagtatattggggaactgaaagatcagatagcagagctgaatcatgagctcaggtgcctaaaaggccagangggcttctcaggccaacctccttttgatggaatccacattgtcaaccatttaataggagatgatgaatcattccattcctccgatgaagattttatagataattccttacaggaaactggtgttggttttcctttgcacggaaaatctggntcgatgtctttggaccccgcagtggcagatggtagtgagagcgaaacagaagacagtgtgctggagaccagagagagcaaccaagtggttcaaaaggagcggcccccgagaagaagagagtcgtattcaaccactgtctgaccatcactgtgacctagactatggatttatttaagggatcagttatcatatgattagggctttttggaaataatttgtttcatatntatatatatatatatatatatatattttacagtcttatctgcctttttatctttgccaaatctttaccactgatttaccattgccataaagtagactggtatatggttaatgtgtaaaacaaggttctaacagtattactgaatattaatgtttcttgtttagaaaatgcaactatatctatatgtgggaaccattctgaagttcaaaactatggaaaattgaattttcttcagacaaaactgctcttgtgcaatattttatgctcagtgagcaaattgtgtatttatgtttatcaatttgttctcaaggtggctgtctacagacatttgaccaagacatacatctgatttaccttgtgtttttttttttattggtgtttttttttttaagacagagattcagtctgtcacccaggctggagtgctgtggtgtgatcttagctcactgcaacctccgcctcccaggttcaagcaattttcctgcctcagcctcccgagtacctgggactatatgtgcgcaccaccacgcctggctaattttttgtatttttagtagagatggggtttcaccatgttggctgggctggtctcgaactcctaacctcaagtgatccacccgcctcagcctcccaaagtgctgggattacaggtgtgagccactgcacccagcctaccttgtctgtttgtgtctgggaggttttttttttctatttttattttttcatgaaaattattggtgggccactgaaagtccccacacacaaagcctttattctatataattttataaacacaaattcatgattatctgttttgagagttttaagttttgttttaatgtttaacttttatgtgcatatgatgcttccatgtgttggttactagagtagtaggttaactacagacatactgttttgtttgtacatatttataaatctgtaccacctaacattgaacatcattttatatgaagaacatacatgttgcaaaatgactgctttcagcatctaacaggacttctgtaaataataggttaaaagttaaaaataaaacactaatgttttaagagctttagtattttgcttagcattcaatactagcagattcataactgatgcctgttcaaaaacactgttggtggaatcttttatttcatgtgtatgtaactactaaatttttcatgactgaagaggttatagcacatattagttagtgctaatattctactgaatataatttaagcaatgggctaaggtccaagaaacatagcaattatatctacaaataatctattaacatgatcttcagaatctctagtttttgttctatagataaagccataagaatcctttcctaccagtttttcctatatcatttagatattatttcctagaaaacaggatgcctgtcactgataagttagagaaaacacccaaattatacttgcactatggaaagacgacatgaatatgttgactgggtactttctactctcatttttgttagcctatgaaaaaaaaaacattttgttaacctatggaaaaagccttggaagagaaaagtagaattcagtatgtatggaggcacagttttgcacagtatgttgcatgcggcaaaaaaaaaaatatgaaatagagtagaagagataaaagtagttttctgtcaaaaactaggagttaagccttcaggtacgttgtggactaggctttccagcaaggtttttgtagctatttgcttgcctgagaaatgaaattgaaaacatacccctgcgtgtctgtccttaacaccaggctaaattctggtggttaaataacttanctgtggttacaagctagtaagtagcagagccaagattttttttaatatagagacaggtgtctcactgtgttgtccaggctggtcttgaactcctggcctcaagtggtcctcctgcctcagcctcccaaagtgtggggattacaggtgcgagctactgctcccagcaagagccaagattttaacctagatctccctaacaccaaagcttttgaaagggttcagctgaagaatttctcaattcttntgttttgtttttatttttgttttttgagatgaagtctcactgcactcaggctggagtgcagtggtacgatcttggctcactgcaacntccacntcccgggttcaagcgattctcctgcctcagctcccaagtagctgggactacaggtgcacgccaccacaactggctaatttttgtatttttagtagagatggggtttcgctatgttggccaggctgatctcaaacttctgacctcaggtgatccacccactttgacctcccaaagtgctgggattactagacgtaagccaccacacctggcaattccctgcttttttgacaacataatttaaatgaatttgatttaaatgtttcctgaatatatatacagatagatagatgagtatcaacacttacaagctctacacagtctgtgagtgtagatactacttactngtaggattgtcttgtgctttggggatttttgttcggagttctatactatcagcccagaaagctatcaatgtccaagtgaagtgagatgatgcatggccacattattgctttgaccctcacatcaagaaatctgaatgatctggaccaggggtcagcaaagtgcagcctacaagctattgcagtcagctgccagtttttacttttttaaatagttgggaaaaaaattccaaagactgatattttgtgtcacatgaaaattatatgaaattcaaattgcagtgtccataagtaaagttttattggggcacacccatgctcacccttttaaatattgtgtatggccgctttgtgctacagtagcagagttgagtcattgcaagggagaccatatggcccaggtagcctaaaatatttatctgatcctttacagaaaaagtttgctaacccttgataacagatactctaaaatgcaggtttttcttcttcaatttagctcagtggtaggtcaaattgtttgcttttgctattaagcttatgatttggaaacgtaaaatttcatggtggatcttataatcagaactattcaaaagggaaaacatgccagccattttatatgatgaagtctcttattccatagaaaactgtagaaagatatctgtatctttggagaaggagaaagaaaggaaagaactccagaatcccatcactgttctttaaagcatgcatcacagacctttaagagtatgctttattgagtaaaggttatagtttgactttaagataagaaattttctagaatcatgtttgaattctaaacgttgatattcttaagtaccatttctgattaggaattaggtgttaaaagaatcatggtaaggaaaccttaatccgttgaaactcttgtaatttggacaacaaaaaactagaaataacactcttttctttgaagatctgattcaaatacaccttagaagagtttaaaatctcccaggcctttaggatgcaataggatattatgccttggtttgactccttttcattcaaattaatgtaagtatgttgttcaagactttgaagcattgaacaatgttctcgacgaattttatttaattactgacattttgtgatatttgaatgttattaagttaaacacttagagttgagtatattcaggggagaaaagtgaatgaaatgactcataataagaaagcttgctcccttgggacagttaccttcctggtgtcattgccatcctgggttgacaagctgagagtagaggatacaagtgatgtgaataaaatggaaattgcattgagttaatgaaacagacacttttagatcaagaaaacacttcaacagcctttttagaaattggcacactcctatagtcccacctactcaagaggctgaggcaggaggatcactagagtacaggagtttggggctgtagtgtgtaatgatcacacctgtgaaagaataaccactgcactccaacctgggcaacatggcaagaccctgtctctttaaaaaaaaaaaaaaatcctgggaaaagaagtcaaagatgtaattttacacaatttctgcccccaccgtcttttttgtttgtttgtttgtttgtttgttttttggctagatactaggtattcagtgtttgctgagatgacaggtttctactaatcagccagttatttgggaaggagaaaaactttttctcaattctgaacatgatgcagcttgttaactctccagatagtgcctttgattgaaaataaggtctacacctttttaagtatattatttctgacatcgtaagaaataatttagttccttattctcatttatcttttatataatgtactgtaatattcaggtttaaagtaaaataagtatatgaattatattttggtaaaactgtttcatgaccagcttgattaatgtatattaacataccagacattgacagcgaacatttcatgaaatcagttatttacttactaaaacaatgagttttagcttgaaagttactgctgctctattattaacaaaactaagttttagctatttatgatccaagtttttacatcacatccattgatctgcctatcccttctttttactccaaagaggagatgatagaataatacattcagtatactaccaagaagcaaagttataatgtgtttcattttgctattggaattttttattgtaacattgtatgataacctgaaatgtttacttgtgccttttctttaaacaattaaagttttccattttataagaaaaaaaaaaaaaaacaaaaaccccgacaaaaacaacaaccagcaacaccacacaaaaaacacacgccagcacacaagacgacacaccacacaaacaaaaaagggggggccaaaaccacgaggaaccacacaccctttatggggccaagagtaataaaaggggggaaaccagagaagacgctggagacctgt

SEQ ID NO: 2061 - DNA, 3667 bp, Homo sapiens
  misc_feature (458)..(458): n is a, c, g, or t
  misc_feature (702)..(702): n is a, c, g, or t
  misc_feature (789)..(789): n is a, c, g, or t
  misc_feature (795)..(795): n is a, c, g, or t
  misc_feature (1139)..(1139): n is a, c, g, or t
ctctacggatccttattttacgcaggctcctagaaaacaggatgcctgtcactgataagttagagaaaacacccaaattatacttgcactatggaaagacgacatgaatatgttgactgggtactttctactctcatttttgttagcctatgaaaaaaaaaacattttgttaacctatggaaaaagccttggaagagaaaagtagaattcagtatgtatggaggcacagttttgcacagtatgttgcatgcggcaaaaaaaaaaatatgaaatagagtagaagagataaaagtagttttctgtcaaaaactaggagttaagccttcaggtacgttgtggactaggctttccagcaaggtttttgtagctatttgcttgcctgagaaatgaaattgaaaacatacccctgcgtgtctgtccttaacaccaggctaaattctggtggttaaataacttanctgtggttacaagctagtaagtagcagagccaagattttttttaatatagagacaggtgtctcactgtgttgtccaggctggtcttgaactcctggcctcaagtggtcctcctgcctcagcctcccaaagtgtggggattacaggtgcgagctactgctcccagcaagagccaagattttaacctagatctccctaacaccaaagcttttgaaagggttcagctgaagaatttctcaattcttntgttttgtttttatttttgttttttgagatgaagtctcactgcactcaggctggagtgcagtggtacgatcttggctcactgcaacntccacntcccgggttcaagcgattctcctgcctcagctcccaagtagctgggactacaggtgcacgccaccacaactggctaatttttgtatttttagtagagatggggtttcgctatgttggccaggctgatctcaaacttctgacctcaggtgatccacccactttgacctcccaaagtgctgggattactagacgtaagccaccacacctggcaattccctgcttttttgacaacataatttaaatgaatttgatttaaatgtttcctgaatatatatacagatagatagatgagtatcaacacttacaagctctacacagtctgtgagtgtagatactacttactngtaggattgtcttgtgctttggggatttttgttcggagttctatactatcagcccagaaagctatcaatgtccaagtgaagtgagatgatgcatggccacattattgctttgaccctcacatcaagaaatctgaatgatctggaccaggggtcagcaaagtgcagcctacaagctattgcagtcagctgccagtttttacttttttaaatagttgggaaaaaaattccaaagactgatattttgtgtcacatgaaaattatatgaaattcaaattgcagtgtccataagtaaagttttattggggcacacccatgctcacccttttaaatattgtgtatggccgctttgtgctacagtagcagagttgagtcattgcaagggagaccatatggcccaggtagcctaaaatatttatctgatcctttacagaaaaagtttgctaacccttgataacagatactctaaaatgcaggtttttcttcttcaatttagctcagtggtaggtcaaattgtttgcttttgctattaagcttatgatttggaaacgtaaaatttcatggtggatcttataatcagaactattcaaaagggaaaacatgccagccattttatatgatgaagtctcttattccatagaaaactgtagaaagatatctgtatctttggagaaggagaaagaaaggaaagaactccagaatcccatcactgttctttaaagcatgcatcacagacctttaagagtatgctttattgagtaaaggttatagtttgactttaagataagaaattttctagaatcatgtttgaattctaaacgttgatattcttaagtaccatttctgattaggaattaggtgttaaaagaatcatggtaaggaaaccttaatccgttgaaactcttgtaatttggacaacaaaaaactagaaataacactcttttctttgaagatctgattcaaatacaccttagaagagtttaaaatctcccaggcctttaggatgcaataggatattatgccttggtttgactccttttcattcaaattaatgtaagtatgttgttcaagactttgaagcattgaacaatgttctcgacgaattttatttaattactgacattttgtgatatttgaatgttattaagttaaacacttagagttgagtatattcaggggagaaaagtgaatgaaatgactcataataagaaagcttgctcccttgggacagttaccttcctggtgtcattgccatcctgggttgacaagctgagagtagaggatacaagtgatgtgaataaaatggaaattgcattgagttaatgaaacagacacttttagatcaagaaaacacttcaacagcctttttagaaattggcacactcctatagtcccacctactcaagaggctgaggcaggaggatcactagagtacaggagtttggggctgtagtgtgtaatgatcacacctgtgaaagaataaccactgcactccaacctgggcaacatggcaagaccctgtctctttaaaaaaaaaaaaaaatcctgggaaaagaagtcaaagatgtaattttacacaatttctgcccccaccgtcttttttgtttgtttgtttgtttgtttgttttttggctagatactaggtattcagtgtttgctgagatgacaggtttctactaatcagccagttatttgggaaggagaaaaactttttctcaattctgaacatgatgcagcttgttaactctccagatagtgcctttgattgaaaataaggtctacacctttttaagtatattatttctgacatcgtaagaaataatttagttccttattctcatttatcttttatataatgtactgtaatattcaggtttaaagtaaaataagtatatgaattatattttggtaaaactgtttcatgaccagcttgattaatgtatattaacataccagacattgacagcgaacatttcatgaaatcagttatttacttactaaaacaatgagttttagcttgaaagttactgctgctctattattaacaaaactaagttttaaaaattaattttaattctactgaagtttaatttctggttaaaggtatagtggatgctatttatgatccaagtttttacatcacatccattgatctgcctatcccttctttttactccaaagaggagatgatagaataatacattcagtatactaccaagaagcaaagttataatgtgtttcattttgctattggaattttttattgtaacattgtatgataacctgaaatgtttacttgtgccttttctttaaacaattaaagttttccattttataagaaaaaaaaaaaaaaacaaaaaccccgacaaaaacaacaaccagcaacaccacacaaaaaacacacgccagcacacaagacgacacaccacacaaacaaaaaagggggggccaaaaccacgaggaaccacacaccctttatggggccaagagtaataaaaggggggaaaccagagaagacgctggagacctgt

SEQ ID NO: 2062 - DNA, 1307 bp, Homo sapiens
ctttttttttaaagagacagggtattgccatcctgggttgacaagctgagagtagaggatacaagtgatgtgaataaaatggaaattgcattgagttaatgaaacagacacttttagatcaagaaaacacttcaacagcctttttagaaattggcacactcctatagtcccacctactcaagaggctgaggcaggaggatcactagagtacaggagtttggggctgtagtgtgtaatgatcacacctgtgaaagaataaccactgcactccaacctgggcaacatggcaagaccctgtctctttaaaaaaaaaaaaaaatcctgggaaaagaagtcaaagatgtaattttacacaatttctgcccccaccgtcttttttgtttgtttgtttgtttgtttgttttttggctagatactaggtattcagtgtttgctgagatgacaggtttctactaatcagccagttatttgggaaggagaaaaactttttctcaattctgaacatgatgcagcttgttaactctccagatagtgcctttgattgaaaataaggtctacacctttttaagtatattatttctgacatcgtaagaaataatttagttccttattctcatttatcttttatataatgtactgtaatattcaggtttaaagtaaaataagtatatgaattatattttggtaaaactgtttcatgaccagcttgattaatgtatattaacataccagacattgacagcgaacatttcatgaaatcagttatttacttactaaaacaatgagttttagcttgaaagttactgctgctctattattaacaaaactaagttttaaaaattaattttaattctactgaagtttaatttctggttaaaggtatagtggatgctatttatgatccaagtttttacatcacatccattgatctgcctatcccttctttttactccaaagaggagatgatagaataatacattcagtatactaccaagaagcaaagttataatgtgtttcattttgctattggaattttttattgtaacattgtatgataacctgaaatgtttacttgtgccttttctttaaacaattaaagttttccattttataagaaaaaaaaaaaaaaacaaaaaccccgacaaaaacaacaaccagcaacaccacacaaaaaacacacgccagcacacaagacgacacaccacacaaacaaaaaagggggggccaaaaccacgaggaaccacacaccctttatggggccaagagtaataaaaggggggaaaccagagaagacgctggagacctgt

SEQ ID NO: 2063 - DNA, 2037 bp, Homo sapiens
ggccagatgtatttaaggggtattcagatgccacctacatgcttattttgtctagaacagtgctgtctaatagaactttctgtgacgatggatattttgtagacttttgctgtccagtgtggtagccactaaccacatgtggctgttaagcccttgaaatatagctagtgtgactagaaagtattttattttaaatttacataggcacaagtggctagtggctactgtattgacattctgggtctaggactagaaccagtggtctgtaacaaaagtactttctctttactctattaaatctagaattagccgggcatggtcgctcatgcctgtaatcccagcactttgggaggccaaggcaggcagatcacttgaggtcaggcgtttgagaccagcctggtcaacatggcgaaaccctgtctctacaaaaaacataaaaattagccaggtgtggtggtgggcacctgtaatctcagctacttgggaggctgaggcacaagaatcacttgaacttgggaggtggaggttgcagtgagccaagattgtgccactgcactcaagcctgggtgacgagtgaaactgtctccaaaaaaaaaaaaaaatctagaattcttggaagtacattatattgcccttcagaatagattccagttcctgttgtgctcacctttataattttaccataagttttacctattcgtaagttggcagttttagatagataacattctggtggtagctagggatttaccttttgtcatccttttcctgcacttctcttgaattcctttatagatgtacagttttgctttaaccactgaagattgctgtaaattataaagggtgtgatagaatccacatggctgtcaagaaggagatcttaccaaggacagttgactgactagtctcagattgtttcatatcatttatacttgggtaagagtaaactagataactgggcgtcgtggtgcacacctgtagtcccagccactctgaggcaggaggactgcttgtgcccagaagttcgaggctgcagtgtagctgtgattgtgctactgcactccagcctgggcaacagataaaggaaactccatctcttttaaaaaaaaaaaaagtggtctgggtgcagtaggtcatgcctgcaatcccagcactttgggaggccaaggcaggcagatcacctgaggtcaggagcttgagaccagcctggccaacatggtgaaaccccatctctaccaaaaatataaaaactagctgggcgtggtggcggcacctgtaattgcagctatttgagaggctgaggcaggagaatcgcttgaacctgggagatgggggttgcagtgagccaagaccgccccatcgcactccagcctgggcaacaatagtgaaactccgtctcaaaaagaaaaaaagtttccttagaatggaaaatattcattcatgagctcttttggcaatccgtcatcagtatattctgaaaaccaataagatgttgccaagttgggggcgagagctatgtaatgcaaggcatatgcctgatgaagtatacaaatacacctgaccagaaactttgtctcccacataagtctcttctaggcactgtcggggtacatactgagctgctgctttggctgtattttctgtgcctcagaataaccattgtcctggtgttcatatccttagagttcagtacaaaatgttggatatccatttaataggttccaggttatcttagttggagtttggggtatttgaaaacgtcatgccttcaggctatcatttccctcagaaagctaagtaaatttactgcattcatttctcaaagagtaaaagtgcaggttgtatgtgtctatgaacatttaaacatgttaaaatgttaaatttaacattttaaatttaaacatttaaatatgtctgtaacttgaacagtgtagtttcagaaaggaccactgggctagtgtaatgcagaaaatgctgggtctaggattaggagaaaattgtgtttagtgtgtatcaataaacagcccgtggacccaa

SEQ ID NO: 2064 - DNA, 2362 bp, Homo sapiens
ggccagatgtatttaaggggtattcagatgccacctacatgcttattttgtctagaacagtgctgtctaatagaactttctgtgacgatggatattttgtagacttttgctgtccagtgtggtagccactaaccacatgtggctgttaagcccttgaaatatagctagtgtgactagaaagtattttattttaaatttacataggcacaagtggctagtggctactgtattgacattctgggtctaggactagaaccagtggtctgtaacaaaagtactttctctttactctattaaatctagaattagccgggcatggtcgctcatgcctgtaatcccagcactttgggaggccaaggcaggcagatcacttgaggtcaggcgtttgagaccagcctggtcaacatggcgaaaccctgtctctacaaaaaacataaaaattagccaggtgtggtggtgggcacctgtaatctcagctacttgggaggctgaggcacaagaatcacttgaacttgggaggtggaggttgcagtgagccaagattgtgccactgcactcaagcctgggtgacgagtgaaactgtctccaaaaaaaaaaaaaaatctagaattcttggaagtacattatattgcccttcagaatagattccagttcctgttgtgctcacctttataattttaccataagttttacctattcgtaagttggcagttttagatagataacattctggtggtagctagggatttaccttttgtcatccttttcctgcacttctcttgaattcctttatagatgtacagttttgctttaaccactgaagattgctgtaaattataaagggtgtgatagaatccacatggctgtcaagaaggagatcttaccaaggacagttgactgactagtctcagattgtttcatatcatttatacttgggtaagagtaaactagataactgggcgtcgtggtgcacacctgtagtcccagccactctgaggcaggaggactgcttgtgcccagaagttcgaggctgcagtgtagctgtgattgtgctactgcactccagcctgggcaacagataaaggaaactccatctcttttaaaaaaaaaaaaagtggtctgggtgcagtaggtcatgcctgcaatcccagcactttgggaggccaaggcaggcagatcacctgaggtcaggagcttgagaccagcctggccaacatggtgaaaccccatctctaccaaaaatataaaaactagctgggcgtggtggcggcacctgtaattgcagctatttgagaggctgaggcaggagaatcgcttgaacctgggagatgggggttgcagtgagccaagaccgccccatcgcactccagcctgggcaacaatagtgaaactccgtctcaaaaagaaaaaaagtttccttagaatggaaaatattcattcatgagctcttttggcaatccgtcatcagtatattctgaaaaccaataagatgttgccaagttgggggcgagagctatgtaatgcaaggcatatgcctgatgaagtatacaaatacacctgaccagaaactttgtctcccacataagtctcttctaggcactgtcggggtacatactgagctgctgctttggctgtattttctgtgcctcagaataaccattgtcctggtgttcatatccttagagttcagtacaaaatgttggatatccatttaataggttccaggttatcttagttggagtttggggtatttgaaaacgtcatgccttcaggctatcatttccctcagaaagctaagtaaatttactgcattcatttctcaaagagtaaaagtgcaggttgtatgtgtctatgaacatttaaacatgttaaaatgttaaatttaacattttaaatttaaacatttaaatatgtctgtaacttgaacagtgtagtttcagaaaggaccactgggctagtgtaatgcagaaaatgctgggtctaggattaggagaaaattgtgtttagtgtgtatcaataaacagcccgtggacccaaaaaaaaaaaaaaaaaacataaaaataacaactaatactgaaaaatagaaaaaacaaaaaaaaaagaaggcacaactgagactacggagaaccaggaacagaacagcaagaagaacagaaagaagaaagaaccgaggaacggaagagcggagcgagaatgaaaaacgagaacaggcaaagaaaaaaacgaaaaggaacgccgcgccagaaaccgacgagagagacaagggcgcccgagcgacgtgcagaacacgaccagggctaataggaacacacaagtaaaggacgcacaacacacaacatcggaacaaacagaaacagcaaaa

SEQ ID NO: 2065 - DNA, 1902 bp, Homo sapiens
aaatgatacaggaaacatattaagatagatacagaaatgtgttcaaccttccatcttggctagttgtggcgtttagtttgttttttgagacatggtcacgctgtgtcgccaaggctggagtgcagtggtgcgatctcggctggctgcaacctctatttcctgagctcaagcaatccgtccacttgccttggctccccaaagtgctgggattacaggcgtgagccaccaggccctgcctggttttcaaattcagaaatcttattatttaacccagaagtaatcagcccagtagtaacttaggtttaattttttttcaggtttaaaatttttctcatttattttttctgagacggagtttcgcccttttcgcccaggctgagtacagtggaggttgcagtgagccaagattgtgccactgcactcaagcctgggtgacgagtgaaactgtctccaaaaaaaaaaaaaaatctagaattcttggaagtacattatattgcccttcagaatagattccagttcctgttgtgctcacctttataattttaccataagttttacctattcgtaagttggcagttttagatagataacattctggtggtagctagggatttaccttttgtcatccttttcctgcacttctcttgaattcctttatagatgtacagttttgctttaaccactgaagattgctgtaaattataaagggtgtgatagaatccacatggctgtcaagaaggagatcttaccaaggacagttgactgactagtctcagattgtttcatatcatttatacttgggtaagagtaaactagataactgggcgtcgtggtgcacacctgtagtcccagccactctgaggcaggaggactgcttgtgcccagaagttcgaggctgcagtgtagctgtgattgtgctactgcactccagcctgggcaacagataaaggaaactccatctcttttaaaaaaaaaaaaagtggtctgggtgcagtaggtcatgcctgcaatcccagcactttgggaggccaaggcaggcagatcacctgaggtcaggagcttgagaccagcctggccaacatggtgaaaccccatctctaccaaaaatataaaaactagctgggcgtggtggcggcacctgtaattgcagctatttgagaggctgaggcaggagaatcgcttgaacctgggagatgggggttgcagtgagccaagaccgccccatcgcactccagcctgggcaacaatagtgaaactccgtctcaaaaagaaaaaaagtttccttagaatggaaaatattcattcatgagctcttttggcaatccgtcatcagtatattctgaaaaccaataagatgttgccaagttgggggcgagagctatgtaatgcaaggcatatgcctgatgaagtatacaaatacacctgaccagaaactttgtctcccacataagtctcttctaggcactgtcggggtacatactgagctgctgctttggctgtattttctgtgcctcagaataaccattgtcctggtgttcatatccttagagttcagtacaaaatgttggatatccatttaataggttccaggttatcttagttggagtttggggtatttgaaaacgtcatgccttcaggctatcatttccctcagaaagctaagtaaatttactgcattcatttctcaaagagtaaaagtgcaggttgtatgtgtctatgaacatttaaacatgttaaaatgttaaatttaacattttaaatttaaacatttaaatatgtctgtaacttgaacagtgtagtttcagaaaggaccactgggctagtgtaatgcagaaaatgctgggtctaggattaggagaaaattgtgtttagtgtgtatcaataaacagcccgtggacccaa

SEQ ID NO: 2066 - DNA, 388 bp, Homo sapiens
ttttttttgagacggagtcttgccctgtcacccaggcaggagtgcagtggcacaatcttggctcactgcaacctctgcctcccaggttcaagagattctcctgccttagcctcctgagtagctgggactacaggtgtgtgccaccatgtccggctaattttgcccagctaatttcaccatgttggccacgctagcctcgaactcctgacctcaagtgatctgcccgtctgggcctcccaaggtgttgggattacaggcatgagccaccatgcccagccccaaaaatcttaaggggaagatttgggaaatggatgtccacagtggaatttgaaaagctccaacatattcctgggatacatgtgtaagactgtgtgcatgtgcagaaaag

SEQ ID NO: 2067 - DNA, 501 bp, Homo sapiens
tagctattcctgctgctctcagcttttatcttattcactgatgctggaaaatctggattaatttatacccttgagtattattagaggcacagcctctatccagaggagcagaactaacatgacctgcagacatcccctgagtttgtatctctgtacccgtaaaactcactgaggaacatggctttgaatgtgggcccaggtatgaaggtaaacaggctctgcaagtgtttatgacaatgcaagattaactttaatatttaaggaaaaattgactttaggaaaagcaagctaagacaaaaatagtaacacaaaatattttctcctgatattaaaaaacaaccctcaagagtttttaacatttatccatctatgtaactttgctacaacctgtctaaattcatcctttgtctctaatattgaaattcctctggtcaacaattttgttgatttttaaaatattattttatccacaaatcttcattgtatcttcttctttaaatt

SEQ ID NO: 2068 - DNA, 429 bp, Homo sapiens
gcacatctgtattcccagctacccaggaggcttagctgggaggattgcttgagcctgggaggttgagactacagtgagccttgatcgtgccactgcactccagcctgggcaacagagtaagaccttgcctcaaaaaagaaaagaaaaagaaaatctactaagtgaggaagagcaaatttatagaatgctgttacaacatgattttgtcctggtgtggtcgctcacgcctataatatacatacacacttagttgggcatggtagtacttgcctgcagtcctagctactcaggaggctgaggtgggaggattgcttgagcccaggagtttgaggctgcaatgagctgtgagcatgccactgcactccagcctggtcaacaaagcaagaccctgtttctggaaaaaataaaaataaaaaagaagaagaaaga

SEQ ID NO: 2069 - DNA, 354 bp, Homo sapiens
tcctcccctttcgcttccttccacacagtccagtgctttgttaggtacctgcatcccagcaggactggggacctggctggatgtgggcttgggtagagttggccagatgaaatgtggttggcaagaaggtcctgagtgtgctgagacaggcaagagtcagtaataagatcagagagtagaagactagggccaggagcgtgggacaggctaaggatgccggctagcccccaatcccagagagcatgcagctgagtctaagagaggcttcactgatacccataaggaggcggaatatgcaaaccctctttgcttaggagaacctgagctcacctgccaaaatcatcctttgacatt

SEQ ID NO: 2070 - DNA, 399 bp, Homo sapiens
tcagaagtatgggaggccctggacttgcgactggcatcgaaaaatgagagcagtcttatgggattgagactttaacctgtgttgtctgcaataagtccaggtgtttagtaagtatcagaattgaatagaattgttgaacacacagttggtatctggagaatcagttgactgccagtattaggaacccttccccagcccataccaaggcacccaaatgtgtgatcacagttgggtacctgagctttggcaggcaggcagtcatgtcaccaggtgcacatgacaaatgtcatgcatgttttaactaaatacaaggtgagagtcagaaattctcttctggtgtttagtagcaatgaagactgcacctgaccaaaaaataaaaattcacgaaacttaaatgct

SEQ ID NO: 2071 - DNA, 265 bp, Homo sapiens
tattaacttcaaaggaaatttctccaagtaattgtggaaagatgtaagtaaatccaatataagaggtgtgattatataggaagctcagaaactgttagggataaacatggaattgattttaggcatagaaagttaattgcactggtgtagaatagggtgacttgacctgacaatagttgccagctgaagaatttctccagaattcatcacataaagagaagttatggaaagtattgacaaggtttaaaaacatgggggaaatact

SEQ ID NO: 2072 - DNA, 465 bp, Homo sapiens
atcatctggcaaacttcctaaaaatatagaagcagcctatgtttcttcaacaagattgcatctttgtattttcttttagttttccatgtgattgtgatacaacactaagccagtggagaaccactgccttagaggaaggaagaaaaggtttggagaaacaaattagtacaggtagaagggccagacatggtagctcacgcctgtaatcccagcactttgggaggccaaggtggtgggcagatcacttgaggtcaggagttcgagaccagcctggccaacgtggtgaaaccccatctctactaaaaatacaaaaattattcgggtgtggtggcgcgtgcctgtaatcccagctactcaggaggctgaggtaggagaattgcttgaacccaggaagtgcaggttgcagtgagctaaggtcgcgccacctacactccagcttaggcggcaaaggaagacactgtctca

SEQ ID NO: 2073 - DNA, 423 bp, Homo sapiens
aagtgcttgccaattaaatataactaggagcaatgaatacaacttttgccttactttgttaaaggaagatggcttgccttggactgctttctttctctttcatggacatgtctgtgaccagctgtgatgatgaagatggggaagacatcctagaagagggtggaacaacaagatggaaggaacctggatcctctatgacctgaattttagaaaggcaaacctagaacagagctgctcttttattctaggcctggctgttaggtctacactgcttttatgagctgtaacactcaccgcgaaggtctgcagcttcactcctgaagccagcaagaccacgaacctaccagaaggaagaaactctgaacacatccgaacatcagaaggaacaaactccagacgcgccaccttaagagctgtaacact

SEQ ID NO: 2074 - DNA, 350 bp, Homo sapiens
gcctcctttccttcctggaagccccagggcctttgtacctgacagtctcccagtcagaaatgccccccagtcagggcgcggtggctcacacctgtaatcccagcactttgggaggctgaagtaggtggatcacgaggtcaggagatagagaccatcctggctaacacggtgaaaccccgtctctaataaaaatgcaaaaattagctgggcgtggtggctggcgcctgtaatcccagctactcaggaagctgaggcaggagaattgcctgaacctgggaggcggaggttgcagtgagccgagactgcgccactgcactccagcctgggcaacagagagagactccgtctca

SEQ ID NO: 2075 - DNA, 350 bp, Homo sapiens
gcctccgcaggggccctgaaggggaagatgtgttctgcaagcatcacagatattgtgagaagcaagaggctgcaatggatgtggaaggctttgagccaggcagatgtgggttcaaatcccagtttcctggctgggagatttgaagcaagtcactcagactctctcaacctcaaaaatagaatatctgcctgatacattgtaggcttatgactccttaccctactctctttccaatgaaagatactattgaaaatttcgctgggcacggtggctcacgcctgtaatcccagcactttaggaggctgaggcgggcggatcacaaggtcaggagatcgaaaccatcctggcta

SEQ ID NO: 2076 - DNA, 1733 bp, Homo sapiens
tgtcatatgactgaggcgcccatgggggtggcggggcggctgtaggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcgaaactctgcagtgatgctcaagttaaagtctttgggaaatgctgccaactgaaacctggaggagacagttcttcctctttagatagttctgtgacttcatcttctgatataaaagaccagtgtcttaagtaccagggttctcggtgctcttctgatgccaatatgcttggagagatgatgtttggctcagtagcaatgagctacaaaggatccaccttaaaaattcatcagattcgttcccctccacagctcatgctcagcaaagtgtttactgctcggactggcagcagtatttgtgggagtctcaatacgctacaagatagtcttgaattcatcaatcaggacaacaatacattaaaggctgataataacacagttattaatggactgcttggaaatataggtctttcacagttctgcagccccaggcgggcattctctgagcagggtccgctccgcctgatcaggagcgcctctttctttgcagttcacagcaacccaatggacatgcctggaagagagctcaatgaggacagagacagtggcatagcacggtctgcatctctcagcagcttgctgatcactccatttccttccccaaactcctcacttacccgaagttgtgccagcagctaccagcgacgttggcgacgcagccaaacaacaagtttggaaaatggggtatttcctagatggtctatagaagaaagctttaatctctcagatgaaagctgtggccctaacccaggaattgtgcggaaaaagaagattgcaattggggtaatcttttcattgtccaaagatgaagatgaaaataacaaatttaatgaattctttttttcacattttcctctctttgaaagccacatgaacaaattaaagagtgcaatagaacaggctatgaaaatgagccggagatcagctgatgccagtcagagaagtttggcatataatcgaatagttgatgccctaaatgaattcagaacaacaatttgtaatctttacacgatgccacgaattggagaacctgtctggcttacaatgatgtcggggactccagaaaagaaccacctttgctatcgtttcatgaaggagttcacctttctaatggaaaatgcttccaaaaatcaattcttgccagctctcattactgcagttctgaccaatcatcttgcctgggttccaacagtcatgccaaatggacaaccacctataaaaatatttttagaaaagcattcctctcagagtgtggacatgttggcaaagactcatccatataacccactttgggcacaactgggtatgtaatctgacaactgttacactatgtattagacttttttgtagctatctgtaattattttatagcaaaaccaaaaataaataaaatgcttttacctcctgcattctaaag

SEQ ID NO: 2077 - DNA, 1125 bp, Homo sapiens
tgtcatatgactgaggcgcccatgggggtggcggggcggctgtaggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcagttggcctttaccagagtttgatccaagccagattcgactgattgtatatcaagactgtgaaagacgagggagaaatgttttgtttgactccagtgttaagagaagaaatgaggacatatcagtatcgaaactctgcagtgatgctcaagttaaagtctttgggaaatgctgccaactgaaacctggaggagacagttcttcctctttagatagttctgtgacttcatcttctgatataaaagaccagtgtcttaagtaccagggttctcggtgctcttctgatgccaatatgcttggagagatgatgtttggctcagtagcaatgagctacaaaggatccaccttaaaaattcatcagattcgttcccctccacagctcatgctcagcaaagtgtttactgctcggactggcagcagtatttgtgggagtctcaatacgctacaagatagtcttgaattcatcaatcaggacaacaatacattaaaggctgataataacacagttattaatggactgcttggaaatatagacagctcaactgaactgctgctgtattgcgatacttctggtgcataaaaagctatgtagtagccaagggaatgggatagcaattagaatagtattaatatttcttccattttctgtttagtaagaacttttatttataattaattttaataaatatttgttatatattagtagaaaagttttttcttccaacttgaactgtatgacatcctattatttattttttataatttgtgtttattcaaatgagcaatcacttataaaacacctattactgtgggctagtcatagtgttaggcatatactttataatgtgtgtgtgttatagaaaaatagaagttctgcattttcttaactcgcttgattacttcattgattttaataaaggaaaaatgtgacaaaga

SEQ ID NO: 2078 - DNA, 748 bp, Homo sapiens
aactattcaagtctttggaatccagatgaataattcagttgtttttattctctttgatgatagacagagtttgcttaatactttgcctcgttttcccattcagtaatttggaaatgtaaggacctgctggttgattcagtaattaattgtgtgattaaacactgaaaataatccataatttttgaagtaaaatggcatttctgttttgtacttatgatctgcaatagctcttatgaatgtgttatctttatttcaagtagtttttaactcctcctcaaccagaaactattaactttcattttaatcttggtgttatatactcatcctttcctctctcttctcctttttttggtgccatttggccacatgaacatatatactccccttgcttactttttcactacattttacctaaggtttcatgaagactgattggaatctgatcagatgtattttgttttcagattcttgccagctctcattactgcagttctgaccaatcatcttgcctgggttccaacagtcatgccaaatggacaaccacctataaaaatatttttagaaaagcattcctctcagagtgtggacatgttggcaaagactcatccatataacccactttgggcacaactgggtatgtaatctgacaactgttacactatgtattagacttttttgtagctatctgtaattattttatagcaaaaccaaaaataaataaaatgcttttacctcctgcattctaaag

SEQ ID NO: 2079 - DNA, 203 bp, Homo sapiens
ccctgacgcattgtggcttctctaacagtcctctttcatgtgtattttacgtttttgccatgtaggtctttcacagttctgcagccccaggcgggcattctctgagcagggtccgctccgcctgatcaggagcgcctctttctttgcaggtttgcgatgtgctgtgtgggtagactagttggtgtgccccaacggctagaatc

SEQ ID NO: 2080 - DNA, 569 bp, Homo sapiens
gtttttgtgacctgtaactcagatgagcagatgttcaaatttgatgtttcttaaaagatttattagaataacaatttatttagtactttggttagctgattgttgttatttaagtaccacattttaaagtgacagactttctaaaatttctggtcattttttctagacagctcaactgaactgctgctgtattgcgatacttctggtgcataaaaagctatgtagtagccaagggaatgggatagcaattagaatagtattaatatttcttccattttctgtttagtaagaacttttatttataattaattttaataaatatttgttatatattagtagaaaagttttttcttccaacttgaactgtatgacatcctattatttattttttataatttgtgtttattcaaatgagcaatcacttataaaacacctattactgtgggctagtcatagtgttaggcatatactttataatgtgtgtgtgttatagaaaaatagaagttctgcattttcttaactcgcttgattacttcattgattttaataaaggaaaaatgtgacaaaga

SEQ ID NO: 2081 - DNA, 344 bp, Homo sapiens
ggttctcggtgctcttctgatgccaatatgcttggagagatgatgtttggctcagtagcaatgagctacaaaggatccaccttaaaaattcatcagattcggtgagaggttttctgatttttttttaacgagtcccatttttagatattttcgtttttttagagagaattttatatgatcttcactcagattgagcttgtcatactccatttaacatgttctatggttttaatgctacttcatggctcttgcagctatgctgtgaaacctctgtgacttacacatttttatttataataaatccaaaaggtcattatattttagttttggtctctctctttctc

SEQ ID NO: 2082 - DNA, 437 bp, Homo sapiens
gagctgttcatccacctgaatagcaatatattttataactgacagtttcatctttatttatagttcacagcaacccaatggacatgcctggaagagagctcaatgaggacagagacagtggcatagcacggtctggtaatgtcacgttcttgtattcagttttttatgagattactgttggcattgattttcttttttatccctccctttattatcaaatttgttcatattgatattagccttacaagagaactgtgaaaagaccagagcaaagtcttataaatttaatatttttcatgtttacttttaagtgtgctaagtaggataaagccaggatgaagtaaagccagagtaaagtacactggttgaagcttagtgaatataagaagaaaagcattggtcagaaaaactgcttagaaactgtagtaaaaaaaaaa

SEQ ID NO: 2083 - DNA, 507 bp, Homo sapiens
ggagcaggggcctagcaagcgcccagcggagcgacccctgcctggccgtggctagcatggcccctacgctgttccagaagctcttcagcaagaggaccgggctgggcgcgcccggccgcgacgcccgggacccagattgcgggttcaggtagggcgctgtggggcgggggtcgcggagccgatggccttgtgggctccgggctccaggggtgttggggccttcggtgttccgacccgagcggaagcgccgcgccgagagcagcatctggtcctcggtggggtggagccggctgcgggctagcgccgaagggttggagcgaggtcctaccttttattttaccccacccgcctcgccgttgccccttccccctcctcccgtcggtttgtttacgacctgcccccagccacgcgcgactctgctcctccggacctagcaccgcggcctgagactttgggtccacacgccttcctggcaccgagtagagttgggcgcgggctggattggac

SEQ ID NO: 2084 - DNA, 530 bp, Homo sapiens
cccacctcattctgtttttcacttttttcttcttcatttctttctttctccctccctcctttccttccttcctaccttcttttctctccctccttctctccctttcttcctttcttccttctctttttcccacctgcctgccataacgatcatgtcttgcctgaaaggacaatgattaatagcatttccttacatttgtatagttttttttaagtactgtcctctatccatttcaacgatttcctttgtcgtctcacttgatccttcataccagcccccatgaaatgaagcagagcagccatttctaaaattattgaaaaggaggtcacgcaatgagttagtaacaaagccaggacaatgagccatgccactcatttgtttattcattcattcatttattcatattgagttctgcactgtaaaattcattacaggttcttacagggagtcagacttcatgcatgccagagttctgtaccagagggcctcatcagtggcaggtgctcccgcccagcacggagaagtcagtc

SEQ ID NO: 2085 - DNA, 490 bp, Homo sapiens
caagcaaccactccttgtgagtttgtggaggacaatagattcatgaggaacttggaaacaatcttagggattggcctgctaagaaaccaaatatgacatcctagcctagagaaagccaaggagtcacctgcagaaagatcagcagagcacaatggtctctcttctgtgagtgaaagctcataatttttcatgaaaaactggtgacggggttaccccataaagaatacatttatatggtggcaaggaaatgactccttgtgtcactataatagaataagcggacaattgcttaactctacactgtcagttacatacaactggcctacttttcttccatacctatgccctctttgggttctaagagggactcatgaggactcttatttaatatttaatctcttacagtgtaatcatgaggcttaaagtattcagcaattcagaatctccttttctctttactttcttttgttttgatgtttgttctctctct

SEQ ID NO: 2086 - DNA, 513 bp, Homo sapiens
atagtgattactaatgcagtttggccactgtcttgatttgtgctacagggccattagtttaatgcaccactgttttttgcaccatcagtgcaaatgtcaactggtgttcacatcagttacatagaaaatgagaacttggtaatattctgaaatagtttcaacctggtagacctcctgaacacttggaagagctacctcaagagtcaacagaccacactctgagaaccactactctggatgcacatataaaatacaggaggaaagagatacatcttcagagaaaagacttgggtcataggaagataagaatggcaaggagccttgttttttttccctgtacattctttgtaccttataaatttggtacactttgtatatattacttttctctgaaaaaattaacttaaaaaaagacacttaaactgacatgaaaactaagtaaaaattaagcatattagtagaaatataagtacacaagtaaatacaaacaaatataagcatactacttataaa

SEQ ID NO: 2087 - DNA, 334 bp, Homo sapiens
aggtgcgcgccaccatgcctggctaatttttgtatttttagtagagacagggtttcaccatgttgcccaggctggtcttgaactcctgacctctggtgatctgcccaccttggcatccccaagtgctgggattacaggtgtgagccaccatgcctggccaagagagtaactttcacctcctttcctacaaaagaaaaaattaaaaaccgctcacatgctaggggcagagacaaactggctctaactcagcacattcctaagaaagctgcatttttggttaaattcatgctgctttttaaaccctttttgtttaggtgtacatagctgtcagatc

SEQ ID NO: 2088 - DNA, 367 bp, Homo sapiens
taatcttttaaattagtttttcatggattctcaacatactttctctgaggatccttcaacagcgagggcggggtacaagcctgggcttttagtcttttggggccatgggagaatatgcagatctatgcagagtacccttaccaggagggttctttgaggcttcaaagaacccagatctttggctaaagttgttagaaatgtcttttccttttcaggagtggtctctgaactaaagctaggtaatttcagccagtgctaagttacccacttgggtggtctagtctactttcatctcctaacttgtttaactttaatactgaatgtggcttttcgtttcttttgattaaaattgacaagctgtaaagta

SEQ ID NO: 2089 - DNA, 309 bp, Homo sapiens
aagtacttacactttgaactttaaaaccgagcagttgagtcattcagtaccaagccaaaacacagaaaaacaaaaaagcagatgaggtttattcttgagaaatgaaaaagagaagaatatatatttcgccttggtgagccaaacatacagagaagaaaaggctttttaaaatcttactagtatgagaggcccagagtaaaaagaaataagcaaaagaatatagacacaatcctaagatgacattcacagaacaaagctgaatcttcaaataatactgtatgagtgaatcttaggaaacctagtgatgat

SEQ ID NO: 2090 - DNA, 338 bp, Homo sapiens
ggagtttacattaaaaggtcttactaagtgattgaaatattcttaaactggctgggcacagcggctcatgcctttcatcccaatactttgggaggccgaggcaggcagatcacttgaggtcaggagttcgagaccagcctggccaacatggtgaaaccctgtctctacgaaaaatacaaaaattatccaggcgtggtggcaggcgcctgtaatccagctacgttagaggctgaggcaggagaatcgctggaacccgggaggcggaggttgtagtgagccaagatcacgccactgcactccagcctagttgacaagagtgagagagagagaccccgtct

SEQ ID NO: 2091 - DNA, 396 bp, Homo sapiens
atatttaataaaatatttaggaagcatttttgtgataatgtagttacaaacataggatacaaaatggtatagcacagtctcagtttaggaaacaatgtgtaagactgggtgtagtggccaacacctgtaatccctaagtccttcgggaggccaaggcaggaggatcatctgagtcccaggagttagagaccagcctgggcaatagggtgagaccacatatttacaaaaaattaaaaggaaatagccgggtggtggtgcatgcttctagtctcagctattttaggggctgaggtggaaggattgcttggagccaggagtttgaggctgcagcgcgctacgactgcttcaactgccctccaggctgagtgacacagcaagcaagaccctgtatctgga

SEQ ID NO: 2092 - DNA, 458 bp, Homo sapiens
aactcctaatacttctacttgctaagaagttaggtccaaacaacttagtagttgttcatatggtgttcaacagatgtcactgtattttcctcaaaaatgtaaaatattctgtgagtaaagccatagtttggggactgtggctctttggaatcaagagtgattaatggccaggcgcagtggctcaacgcctgtaataccagcactttaggaggccgaggcgggtggatcacaaggtcgggagttcaagatcagcctggccaagatggtgaaaccccatctctacgaaaaatacaaaaattagctggacgtggtggcaggtgcctgtaatcccagctactcaagagggtgaggcagagaattgcttgaacttgggaggtggaggttgcagtgagctgagatggtgccactgcactccagcctgggtgatagagagtgagactctgtctcaaaaaaaaaaa

SEQ ID NO: 2093 - DNA, 446 bp, Homo sapiens
agtgaaaaggcagacacccgaaggaactttccagtcactggggacggttgtgccgcattcctttagggggaggcagggcagacccaaatgccctttggtagccatggacaggcagagctgagtaaggccagtacatggcgtctgctgctgtgtacggagcctctgctatgtgccagggactgtgccaggcgctagagatacagaacttgacaaagccaactttccactttcatggggcatacattctagtgtggagagacaccgctaataatgatttttaaaaagaatttaaaaatgtacagggtagacatatatggagattgtgtggggatgaaaagggggaccccccacacacataaggaggagaattcagatgatggtcagagggttctagagacttaggacctcagccatctgaagccacatcaattgagctttccttcagg

SEQ ID NO: 2094 - DNA, 357 bp, Homo sapiens
  misc_feature (13)..(13): n is a, c, g, or t
tacaacccctgancctcctgtgccgaggtgatcttatttgggcacaatttagcaaatttagttttgttgttgttctttgtttttaacgtgtaatggatttgatttattacattagaaagggaaatggacttttaggcacgtggtcaaagcagaaattactgcagctaagagtagaaagggcaactaatcgacatgcagagggctgcacatagacacagggaaacacacacacggagatgcacagaaacacgcagaccccatgcagggacctgctttcccgccacagaggaaagcaatctgatcaaacagacccactgtgcacccagccctccatgcttggggacaacacacctacaa

SEQ ID NO: 2095 - DNA, 448 bp, Homo sapiens
gagtctgagttaggtgccctgacttcagggctccgcttcctgctcccacctgtctttcccagaccagatgggtttggggtgctctgcagaggactagctctgcctggttttggcttgtcctctggtgtttctttatttacactcctctgccgccaaagacgccggccaggggttgcaggcactgagctagatccacttaaaatgctggaaggctttgatgtacagataccaggagatggctttgagcgactgagcctgatctttctgggcaacaggtgtttgtccacagaggggtacaagctgggtggggagagcactgtaggatcaagggcagtgtcattcttgttctctctaggctcttgactatggcttgatggtgaagagtttttttcttgtggagttgggcaggctctggccttcctcttgagcagaagagtgccagacaaat

SEQ ID NO: 2096 - DNA, 619 bp, Homo sapiens
acagggtcttgctctgtcaccctggctggagtgcagcgatatgatgactgctctctgcagccttgacctcccatcctcaagtgatcctctcacctcagccccatgagtagctggaactataggcgtgtgccaccatgcgccgctgatttttctgtttttttgtagagacagcatttcacgttgtgcccaggcttgtgtttgtatctctaatgaccttttttttttttttgcattttttctatacatatatatatatatatatatatatatagatttgggtgtgtgtgatcatgattaatttttagatttttggtggaaccttagacattgcctagcaccccttttccatccctttcccattttgtaaatgaggaaacaagtctaaatggtcaagtggcatacccaagttattggagctggctagtgatacaaccaggactacaccccaggtctttggactcccatgccagtattcatcctactaaagtagatgatagtcttaagaaagtacaaattgttgggaggaacaaaactagtttgcttagttgcataatttttttttctttgaagatttctttggtgtgcttgactcagaaaatccaactttctggtattacaa

SEQ ID NO: 2097 - DNA, 349 bp, Homo sapiens
cttgaactcctgacctcaggtgatctgcccacctcagcctcccagagtgctgggattacaggtgtgagtcaccacacttggccttgtactaagtttttgaagaaattctattgctaaagaaaccacaaatctgacttggaaatgccagtcattgttcatatcctaaggcagtctctaggaaaacatattctccaacatccacttcaatttttaacctgaagaataatgcacaaggaagaacctcccagagggtgaacccaggggcccagatgaggctaatcaaggaatttctttcatggccagtggagagatttctgcttggaaagaaaacaaacgaacaagcaattaa

SEQ ID NO: 2098 - DNA, 305 bp, Homo sapiens
cattttagtgtgagccggctgggagccaaagagtttccccgccctcccctgagtctttcctccttgccttccccttgggtgaggaagggtcacaggtatgatgttcaccctgcaactgaagaaagggcctgtcagcagccccatcggggacacccagcatctaagggggaatgcaggggtgggctggctgtgcttgaagcaatgagtgaaacaaggaggaactagtatctttcctaaatatgtctatatatgggaaactttcttctaaacgtgtctgtatatgggaaacttaacccacgtgagtt

SEQ ID NO: 2099 - DNA, 448 bp, Homo sapiens
ggtggtggggtccaggcatgggggtgtttaaaaactccgcgggtgattctaaagtgcacgcagggctgagaaccattgctcgcgcgcacaggctttgtgagatccacatttactactgagaggtttttccctctggttctctccccaaagtgtgcccccaagttggggtagcagctctgtggaagccaaaggcccagatggtggaggtgtcagcgatgtttaggctgctgctgtgcttgctaaagtgagcggccccaacactcaggtctgtgtaagagcacgttcctcagggctttcggagatgatgtcagtttctctttaagatggagctgttttagtccccgtcctgatgcagcttcccctgcctctaggggcttcctgggaccatgctgactttgactcctgaggagagtggaagataatgagaaataaatcttgagaaaacacc

SEQ ID NO: 2100 - DNA, 180 bp, Homo sapiens
aatcccaactacttgggaggctgaggcaggagaatcgctggagcctgggaagtcaagcctgcagcgaaccatgatcctaacactgcattctagcctgggcaacagagtgagactctgtctcaaaaaaaatcttcatataaaaatatttatttccccccaagtatttaaaaagtgatgttc

SEQ ID NO: 2101 - DNA, 449 bp, Homo sapiens
cttctagtaataataaaatgagtgatttggaacaaacatgtagcagaggaaaggtgagcaaactttttaaatgtcaaaagacatcaaaagacaagataatggagaaatggtgggccaaaattcagaaacagttgggagagtcatgcatttggggctacttttctcctggggatgatggtctagtctaggatctgaaaagcctagaatctctgcagcacttttgacacctatatgaagctgggggaaagaaagattctagcaaaaattaaaatgcacatcttttcaggcgcacataagatttgtacaaatgagtaaaatgatatgggatttcaaaatactgaaatactatgttttcgaatacagtgaaatttggctagaaatcaataaaaatacaactaaatgattcatgtgtgcatttaataaatattgtctcatctccaaacccacca

SEQ ID NO: 2102 - DNA, 407 bp, Homo sapiens
gagcaatggtatgatcatggctcactgtagactttacctactggctgaagctgtcctctcacctcagtttcccacccttacccacccagtagctgggattacagacactcaccaacacgcctggctaatttttattatttgtagaaatgaggtctcactgtattgcccaggctggtctcgagctcctggcctcagacatcctgggattacaggtgggagtcactgtgcctgaccagcattgtttttttgtttttgtttgtttttttaaagataaattaattggccatgtgtggtggctcacgcctgtaatcccagcactttgcgggggctgaggctggtggatcacttgagataggagttcgagaccagcctggccaataaggcaaaaccctgtctctactaaaaat

SEQ ID NO: 2103 - DNA, 186 bp, Homo sapiens
tgatctgcctcttccatagtaggaaatatcacaagtcaaaattgtcctggcttatacgtcacaccctcgacaaaaattaactcaaactgtatcatagaccaacatgtgaaacctaaacctataaaacttccagaagaaaatataggagaaaatctttgtggccttgggtaggcaaaggtttcctag

SEQ ID NO: 2104 - DNA, 290 bp, Homo sapiens
gagtggagagtgtctgggacccagctgggtacaggaccagggaggaggggacgctggggaaggtccctgacagcccctagcctggcctgcttcctcatctttgcctgctccatctttctgcctgcactttcttgccccatccttccctcccctcccctcatgtccattaaggtgaggatggacagtcacctccctatattgtcccaactaacccttgccccttgttgctaggccatcaggttacagagcagggccttccccctctattttgctaaagggcaggtacaggg

SEQ ID NO: 2105 - DNA, 224 bp, Homo sapiens
gaaatgagagaccagaatggaggctttttgactctatatgctggtagagcgggtattgatggaataatccttattctttctaataggtccccgtggccgggtgcggtggctaacacctgtaatcccaacactgtgggaggctgaggcgggcagatcacctgaggtcaggagttcgagaccaacctggccaacatggtgaaacgccatctctaccaaaaatacaa

SEQ ID NO: 2106 - DNA, 431 bp, Homo sapiens
tatcttaaattatgagctctttgagaggaggaagaatcaaagatacaaagatactcatctttgtgaccacagagcccagcaatgttaaaacaaaacaaaaacagttaatcttttcaactatctttagctcttccatcagctgcaaccaggccaaccccaggcatcgaccttagaaagactgtaccattactttcttatctgttctcattgctggtcatcttggaagaactacagtcagacttggtggctttaagaatagaatggagggctgggcgcagtggctcacgcctgtaatcccagcactttgggagaccaaggcgggtggatcatgaggtcaggagatcgagaccatcctggctaacatggtgaaatcccatctctactaaaaaatacaaaaaattagccaagcatggtggcgggtgcctgtagtc

SEQ ID NO: 2107 - DNA, 357 bp, Homo sapiens
aataatcacaataaacacaaattcttatcattatagagcaacaatgaaacaaaatttctgcctggataatcaaaagcaatctaagaaatagattttattttaaatacaatctaatgttttcgatccttttgctaagcctacttaaaatattttaatgccttttcaagagtacacagcaaaaatctgactcgaaaggattcactggacatcaaaggcatgttaataattttctgttgtcctggggatttttctaagatgtctgtctgctgtacatgaaagctaaaagaccaaagtcttccattcagcccagaagttgattattcaatataaatagacatagaatgaatgagtcacaca

SEQ ID NO: 2108 - DNA, 380 bp, Homo sapiens
gctgcaggcggaacaccccagcacctgctcaaacccagctggggaggcccagagttcccacttgcttttgggcattaggcaatggcaaagttaaaagtgaaaataaacctggttggaagttctatgaggaaaacaaggattctaatgattcactcactggttcaacacaaagtgccacaccaggctgagcctccctgggaaagaataagtattaggaccgagaagttactgttccctgagcagccttgttgtaacaggaggctccatttgactgggtgtggcggctgccacctgaaatcccagcacttgggaggccaagacggatcacgtgagccagagtttaagaccagcctagacaatatagtgagaccccatgtctg

SEQ ID NO: 2109 - DNA, 560 bp, Homo sapiens
ttagacccacgcgtccggaataatcagaaaggggctcagctctgtagaaaacaataataataattaaagtttgcttctttagtgtctggaattccaactgggacaagctcaaagctttggtttatcatcacaaaagagccacagagccctcaagagccctttctgagtttccaaagaaaatctaccaaggcagaaactctttcttcaagattttttttttaattaaaaacaaataaaggcaaacacaaacacattccaatacagaagcatatctgaagagccacaaatccacaaggtttcaagcctttggccagtccaatccactagtgtaaaatgctagacataatttcagccagcatgaggctctcttctacattacgacttacctttatttatgtcctcaaagtttgtattatatttttctctctctctaaaattttacagtttatgtagcttctcatttgatttttaagttcacatgcaaattctatcttcagctctaaactaatagcacatatgttttgtttatctgtatggcggcaagacaatttcatgatctg

SEQ ID NO: 2110 - DNA, 424 bp, Homo sapiens
tctgtttctgttgggtgatgggagcttggagctgtctactctgcccttttgctgatatcagtcctcaattatattttaaagagatttaaataataaggaaaaacaggcacatataaatatatgtagttaccattttcaatgcctttcattcctttgtatagatcccgatttccatttggtatttttcttctgcctgaaggacatccgctaacatttcttactgtgtttgttggtgatgaattctttcagctttttatttatttgtttgagacagagtctcgctctgttacccaggctggaatgcagtggcacaattatggctcactggagcctcgacctcccaggctcaaggaaaccccccaggctcaagtgaacctcccagctcagcctcccgagtaactgagactccaggcatgtgccacta

SEQ ID NO: 2111 - DNA, 376 bp, Homo sapiens
gacagaagccgttcacaggcccagcggattctggcgcagagctccctgaaggccacagaaccacagaatcgagctcagggtcttgtgagacatctttgtggtgtggcaacggaaaaccagcccacctcttaacccaaggtgttacgtcctgcatctctctggggtgggtggcttcttctagaggtagcattttggaattctctgaaagcccgcagagacaggtgttgcatgagcagcaagcattagtcccaattttaataaagcccagagcttcctaccacaagctgcgtggcacagacaaccaccaatgctacagtgatacagcccctccctaaaagcatttatgttaatgaaaaaataaatactgtttggtaaa

SEQ ID NO: 2112 - DNA, 150 bp, Homo sapiens
acctcctcttgctcacacatgaaatgaagttaataatagtacctacctcatagatagggttatagtaaggatcaaagaaaatacatgtaaaatgatttgcaccagatgctggaaataaaaagcaaatgaagtccttctgttagattgtca

SEQ ID NO: 2113 - DNA, 465 bp, Homo sapiens
cgggttagagagcacgggtttggctgtgtgctggttattctctgtgtgccccccagacacccccacccagccttacccgtatcccgtatggctgtgtcaaggggcgcccctgcccaccagctgctcatcgtgtatggctaagaggaagctcacagaaaataatggggtggggcgagagagatcggggttttatccccagaccccttctcccggtcctgggcaggagcgcctgcgtctccctgccatggactgctgggcggcccgggccctcctctggggtctgcctgcgtccctcctgtcctcaggcgtggggtcagccctggctccccggctacctaaccccaggttcttgctctgtccttttcctagtttcccctgactctaacccataaccttagagaacgggcccctttcttttaaaacccttttggggttcattcttgcttgggtgttgcgccctctgct

SEQ ID NO: 2114 - DNA, 488 bp, Homo sapiens
gttgaccaatagtaactaacatcttgaacttgggagtttgttcacctatagagttaaatcatatatttttgtgtgtagtctattctgagtaaacagaatgtagagaaattagaagtagtaaggaaagaaacaagggctctaaaataaatactaagcaaatatcaattccatgtggaacaacagggcaccaattccaatcagcttcaagagataagaagaagttggagatgggaaaggagatagtcatcttccaggagcaggaaaagaccagtgtaatagagaaaatgggaatgattgtccacaggacgttatagacttgacttagggaaactgatttagcaagaatatggaagccagcaccatcctgaactctggctgaagtatccagtccatctctgtctgactcctacatactagagattcatagaggggcatacaaattgaatgtatccagcgagcttagagagaaatgggttagaatgatttct

SEQ ID NO: 2115 - DNA, 396 bp, Homo sapiens
aactcgaatggaatcatcattgaatggaatcgaatggaatcatcgagtggaatcgaatggaattatgatcaaatggaatcgaatgtaatcatcatcaaatggaatcaaaaataaccatcatcaattggtattgaatggaattgtcatcaaatggaattcaaaggaatcatcatcaaatggaaccgaatggaatcctcattgaatggaaatgaaaggggtcatcatcaaatggaatcgaatggaatcatcatcaaatggaatctaatggaatcattgaacagaattgaatggaatcgtcatcgaatgaattgaatgcaatcatcgaatggtctcgaatggaatcatcttctaatggaaaggaatggaatcatcgcatagaatcgaatggaattatca

SEQ ID NO: 2116 - DNA, 2137 bp, Homo sapiens
  misc_feature (574)..(574): n is a, c, g, or t
  misc_feature (754)..(754): n is a, c, g, or t
  misc_feature (903)..(903): n is a, c, g, or t
  misc_feature (1397)..(1397): n is a, c, g, or t
  misc_feature (1834)..(1834): n is a, c, g, or t
  misc_feature (2137)..(2137): n is a, c, g, or t
taattttttatagaggtggggtcttgctatgttgtccaagctggtctcgaacttctggcttcaagcagtccttctgccttggcctcccaaagtgctgggattacaggtgtgagccactttacctggcccataaatatattataactaaaatttgctctttaactgtttactgaaagtacgggttgtcatccttttattttctataggccaacacgtttagtgctactaggagacaaaaataataaagtaatactgataggtaaaaatgctatatttaaaattcctaaaaatttgcatatcaaaatttaagttgttcatataatttcttaggggaaaatgaagcagaaagaagtttatttaaaagttatacccttgtgattgaaaatctgtctaaaatatatcagtttcttttcttgttctagttcaaggtggtaaacataattaagctttattgagtatcttgccacagaatgaatcatgaatggttacgtttactatgattttatcaatgatctatgtggaaggtgggagattaaattaaatgtgtgcaggcatcagccaaaaatttattaantattttaatgctttacattttttctttcaggtagaactatgagagatagtatattgcaggctctaatttctttggtttctaatgtttgactatataagaatataatcatcataagatggcaatattcattattaaatttaatttatgctaccactcaaatggttaggttgtgaaataagnttgtttaatagtgtttgaaagatttgtatacccctgagactctagctagcaccctgactgatgccctgacagaaaaagatgattggagcattcagaagttatgcctcactcggggaggggcagttgagatttgttccctgataccaganccattccttgaatactttgtgactgatgagattgactttggagtgggagacagagaaagaatttggggtgcggtagtatcttggaggcttaagggagagcaccaagaagcagatcacagggcagaagagggatgagtgcctttcaagagaaggtggggaggtttgagaggagtgagtcaatagtgtagagtcctcacacaatcctgcctcccagctgttccctttgccatcagatgctgagtgatttgacattacagatgaccatggagggcagtgtgggtgatgaggaaggctgcaccgcactgtgggattcacattaggcagtccaatataaaccagacttacaccagactcatgcaacaaatttgcccactagccattattcacaaattactgaagttatcactgactgataaacacagaataccagcaggtgggaggaaatgttgtctagtttctattattagcttgtgctccatctgctgattataaangtttcactggttcatttattttaacctctcaattgaatcttactgcaggaaaacaaattgtagaatacatcttactagttgtgggaaatcaaatttaatttgaatagcaaaaagtaaatagaatgatattttatgctgaatctaagtagccacatccgtagtcttctttattaaaggaatgttgggttagctcaattgtggataattttattattttcatttaggaaacaattacaacatattagataaatggtaaatcattttttaccctttcttctccatgatttaaaaaataagaatggaaaacatgaattttacatttttttcccactgcattaagttttattattactgtggtttgtttttatttcaaacttttcatgtttcatgtctctcaacgctttttgtcctcaaactttattgctggagtatttaanagcaaatataaacgattcctatagacttttgtatttttgagaaaaaagtagcacactttgggaggctgaggtgggccaatcacctgaggtcaggcattcaagaccagcctggccaacatgtccaaacccctcctgtactaaaaatacaaaaattagccaggtgtggtggcacatgcctgtaatcccagctcctcgggaggctgagtcaggagaatcgcttgaacccgggaggtggaggttgcagtgagctgagatcataccatcgcgctccggcctgggtgacagagcaagactccatctcan

SEQ ID NO: 2117 - DNA, 436 bp, Homo sapiens
  misc_feature (436)..(436): n is a, c, g, or t
ttccatgtcatcattctgctaataatgctcagattattccttaaatataaaaattaaatagatgaatgaaaaaacaaaaaatagaaatggtagtagatattaaggaattagaaattggctttagtttctctcttaataattattatgtggacggctgggtgtggtggctcacgcctgtaatcccagcactttgggaggctgaggtgggccaatcacctgaggtcaggcattcaagaccagcctggccaacatgtccaaacccctcctgtactaaaaatacaaaaattagccaggtgtggtggcacatgcctgtaatcccagctcctcgggaggctgagtcaggagaatcgcttgaacccgggaggtggaggttgcagtgagctgagatcataccatcgcgctccggcctgggtgacagagcaagactccatctcan

SEQ ID NO: 2118 - DNA, 5458 bp, Homo sapiens
  misc_feature (185)..(185): n is a, c, g, or t
  misc_feature (246)..(246): n is a, c, g, or t
  misc_feature (294)..(294): n is a, c, g, or t
ggtggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcntgtgggatctccccgttgctcctgcccgtggactgagtggcaggccatcctacaagcaccnggacacttgacatcagtggtgtcaagacaactctaagaaggttttccntgatcctgcaagccctgccttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcacggcctgcatttcggcccctgcgggacaatggaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcaccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggccttccagcgcatcaacagtgcactgcaggttgaggacaaggccatctcggactgcagaccctcacggccttcccacactttgtcctcacttgcaacaggggcttctggtctgcctgccgtttctaaagcacccagtatggatgcacagcaggagacacacaagtcccaagactgcctgggcctactggaccccttagcatctgctgcaggggtcccctctacagctcccatgtctgggaagaagcacagaccaccaggccccctgttctcctcctcagatccccttcctgccacctcttctgattcccaggactcagcccaggtcacctcgctgattcctgcccccttcccagctgcaagcatggatgcgggcatgagaagaacaaggcatggcacttctgctcctgcagctgccgcagcagcccctccccgctccacattgaaccccacgttggggtcactactggagtggatggaggcccttcacatttctgggcctcagccacagctgcagcaggtgcccagaggtcagaaccagagatcccagacctcctggaccagctcgtgccccaaatgaaatgccatctcgagcccctacagctctacgggaggcctcccggaacaaaagcggaagaggggccagcctcatcccactgccagctgaccctcagttcctcaaacacagacccagggtgcatgcccatctccagcccagggcagctcccctgtaagctgggtgagctactgaagccaaggtgggaggcagctgacaacaccacccacggcccatgcagaggtggtagaaaggctggactcagcaggaacaccaaatcccggaccaggcagaaaccacccaagactgaggggctcgtgccagagcggtggccacagggctgaatggtcgctgagacagagatggaagccaggacaagggagcccaccgggcccagatagagacttcagaacccactcctgagaacagcggagccaggcgcttagaggaagaccaaatgctgccaggacacggattgtccagggattacattccagcatcttattagaggacggaagcagagggtgctgtttcaacgccaccaccaggagagaggcagaggggctgtgccgtgctagagtcctcagggagggagtgacctcgaccctggctgtgctgcaagctgactccagccttgggctcagcagcacccggtgaacagcagcaggaggagccgctagagcagctgctcatgggcagagcagcccttgggcaactcctgccaccaccccctccccagggagcccaaggcaggggaggctcagcatggaatgaaacaggggagtgagggacacaaggaggtgggaagtgggagggtcccagccccaccaagtacgcagagaccccctcgtcgtcctggacaccacaggggcacctgcaggctgggagaccaggtcctctgtgcatgggcccgggaggcagacctgccccaagggtgatgcagaggccacaggtgctgcacgctccagcgcccactctagacatcagcctccaggttgactaagggtcaggtcatgtttgaaaccatgcttggctggaccgggacccatggcaagagcacctgggcaccagtgtttagccctggtctgcaggaaggaggacagcagactttaggaccccacagcatggcagtgctgaccatttcacccacttggcctccttgaggaatagggatggggagccctctggggatgagcaaggccttccaggacaggctcggttctggtcccctgctttttgaggttgggttaaaatgccgaccatggcagaggggtcacagctcaggttcccacacctcacttttcacagcctccaagggcagcagtgcacatggaggagacgtctcccacgaggccaaggcctccaatgctcaccgatgccctctgcgaagctggggtagaactcgtcagtgaagaggggctcaggcagctcacggaagtacagcttcagcgtgcctgcgatggcgttcatgtccgtctcgctcatcatcaccgacatgtccttcttatctggaaagagcacggaaatgcagcggcctccttgaagatcctgataaatgaagaaaagacacagagaaggatgtgacatgcctgggccatggagcactctgagatctcatcgcggacaccactgcccacacctccatcccgtcctgcgcaggccaacactcactgacatcgaaggctgccttcagtgcctggatgtctgcggccacaccggccggacacgtggtagatgcccacctcctccatgcctcggcgctcgatctcctccacgcactggcgcacgatgtagggcaccttggacctctctctcctgtgggaggggggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcttcacggcatgtgctttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaatccctgacccctgccctgggccttaacacacatccgacgaatgaatgaagggttgcctcagtaccggtgctccaagtcctgcgatgctaagtgcttttctcctctgagtcttagcaatggacaattccaatacctccacacaggacactagagtaagaaaccttcacagttagaacgcagtgctgtgcggaggccttaacttgagttctgttttgcacctggatttaccagcacatcaaagctgcttcgcaagccccctcattagcagggcttatctgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaacaggcttctcttggcaacagactcatgacaaaggattcaagattgtttgaaaaaaaaaaaaggggagcagggaggcagaaagtcctggaaaagtaaattgtttattttacaataagaaagtgattacatattttttttttttacaatggtggaaaattagaagtcattgtgaaaatgatgtctacctgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcagagattgcccccgctacactccagcctggtcgacagagtgaactctgtctcaaaaaaaaaaaaaaaagaaaagaaagaagaagccattcccaacgttgctcatcaaattatgaccataaatttccaggatcagactaacggctaaagagactgatgcatcaacaccaggcagagaataaagcagatttttttgttgttgttctggagagcttctaggaacttgaaaaatacatatgccacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagatagaaaaccctaaattaaaggtgaaaaaaccagacaccaagtggcatttaaataaatgtcaactttaactccacaaagcatctggttgcatgtggacagaaagagaaggaaagagggccctatatttggataacttagaaatgtgctccccctagcaagatatctaccaaaattaaaaccatatttgaggatgctggcactgcgagtaatatataaatgatgcatgtaacgtcatttaatatgatcttatttttaaaaatgaaaaaaaaa

SEQ ID NO: 2119 - DNA, 3615 bp, Homo sapiens
  misc_feature (185)..(185): n is a, c, g, or t
  misc_feature (246)..(246): n is a, c, g, or t
  misc_feature (294)..(294): n is a, c, g, or t
ggtggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcntgtgggatctccccgttgctcctgcccgtggactgagtggcaggccatcctacaagcaccnggacacttgacatcagtggtgtcaagacaactctaagaaggttttccntgatcctgcaagccctgccttccttcctgggatcctgccttcaatttgattgcacagaggacggaagcagagggtgctgtttcaacgccaccaccaggagagaggcagaggggctgtgccgtgctagagtcctcagggagggagtgacctcgaccctggctgtgctgcaagctgactccagccttgggctcagcagcacccggtgaacagcagcaggaggagccgctagagcagctgctcatgggcagagcagcccttgggcaactcctgccaccaccccctccccagggagcccaaggcaggggaggctcagcatggaatgaaacaggggagtgagggacacaaggaggtgggaagtgggagggtcccagccccaccaagtacgcagagaccccctcgtcgtcctggacaccacaggggcacctgcaggctgggagaccaggtcctctgtgcatgggcccgggaggcagacctgccccaagggtgatgcagaggccacaggtgctgcacgctccagcgcccactctagacatcagcctccaggttgactaagggtcaggtcatgtttgaaaccatgcttggctggaccgggacccatggcaagagcacctgggcaccagtgtttagccctggtctgcaggaaggaggacagcagactttaggaccccacagcatggcagtgctgaccatttcacccacttggcctccttgaggaatagggatggggagccctctggggatgagcaaggccttccaggacaggctcggttctggtcccctgctttttgaggttgggttaaaatgccgaccatggcagaggggtcacagctcaggttcccacacctcacttttcacagcctccaagggcagcagtgcacatggaggagacgtctcccacgaggccaaggcctccaatgctcaccgatgccctctgcgaagctggggtagaactcgtcagtgaagaggggctcaggcagctcacggaagtacagcttcagcgtgcctgcgatggcgttcatgtccgtctcgctcatcatcaccgacatgtccttcttatctggaaagagcacggaaatgcagcggcctccttgaagatcctgataaatgaagaaaagacacagagaaggatgtgacatgcctgggccatggagcactctgagatctcatcgcggacaccactgcccacacctccatcccgtcctgcgcaggccaacactcactgacatcgaaggctgccttcagtgcctggatgtctgcggccacaccggccggacacgtggtagatgcccacctcctccatgcctcggcgctcgatctcctccacgcactggcgcacgatgtagggcaccttggacctctctctcctgtgggaggggggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcttcacggcatgtgctttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaatccctgacccctgccctgggccttaacacacatccgacgaatgaatgaagggttgcctcagtaccggtgctccaagtcctgcgatgctaagtgcttttctcctctgagtcttagcaatggacaattccaatacctccacacaggacactagagtaagaaaccttcacagttagaacgcagtgctgtgcggaggccttaacttgagttctgttttgcacctggatttaccagcacatcaaagctgcttcgcaagccccctcattagcagggcttatctgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaacaggcttctcttggcaacagactcatgacaaaggattcaagattgtttgaaaaaaaaaaaaggggagcagggaggcagaaagtcctggaaaagtaaattgtttattttacaataagaaagtgattacatattttttttttttacaatggtggaaaattagaagtcattgtgaaaatgatgtctacctgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcagagattgcccccgctacactccagcctggtcgacagagtgaactctgtctcaaaaaaaaaaaaaaaagaaaagaaagaagaagccattcccaacgttgctcatcaaattatgaccataaatttccaggatcagactaacggctaaagagactgatgcatcaacaccaggcagagaataaagcagatttttttgttgttgttctggagagcttctaggaacttgaaaaatacatatgccacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagatagaaaaccctaaattaaaggtgaaaaaaccagacaccaagtggcatttaaataaatgtcaactttaactccacaaagcatctggttgcatgtggacagaaagagaaggaaagagggccctatatttggataacttagaaatgtgctccccctagcaagatatctaccaaaattaaaaccatatttgaggatgctggcactgcgagtaatatataaatgatgcatgtaacgtcatttaatatgatcttatttttaaaaatgaaaaaaaaa

SEQ ID NO: 2120 - DNA, 3700 bp, Homo sapiens
tgtcgtgtgagccttgctctcctggggaggctcaggctgacggctgatgtgggcattgccgagggtaacctgtggcccagtgtatatggccgggtctcctcaagctgcattcattcaagtaggacccagggtgcatgcccatctccagcccagggcagctcccctgtaagctgggtgagctactgaagccaaggtgggaggcagctgacaacaccacccacggcccatgcagaggtggtagaaaggctggactcagcaggaacaccaaatcccggaccaggcagaaaccacccaagactgaggggctcgtgccagagcggtggccacagagacttcagaacccactcctgagaacagcggagccaggcgcttagaggaagaccaaatgctgccaggacacggattgtccagggattacattccagcatcttattagaggacggaagcagagggtgctgtttcaacgccaccaccaggagagaggcagaggggctgtgccgtgctagagtcctcagggagggagtgacctcgaccctggctgtgctgcaagctgactccagccttgggctcagcagcacccggtgaacagcagcaggaggagccgctagagcagctgctcatgggcagagcagcccttgggcaactcctgccaccaccccctccccagggagcccaaggcaggggaggctcagcatggaatgaaacaggggagtgagggacacaaggaggtgggaagtgggagggtcccagccccaccaagtacgcagagaccccctcgtcgtcctggacaccacaggggcacctgcaggctgggagaccaggtcctctgtgcatgggcccgggaggcagacctgccccaagggtgatgcagaggccacaggtgctgcacgctccagcgcccactctagacatcagcctccaggttgactaagggtcaggtcatgtttgaaaccatgcttggctggaccgggacccatggcaagagcacctgggcaccagtgtttagccctggtctgcaggaaggaggacagcagactttaggaccccacagcatggcagtgctgaccatttcacccacttggcctccttgaggaatagggatggggagccctctggggatgagcaaggccttccaggacaggctcggttctggtcccctgctttttgaggttgggttaaaatgccgaccatggcagaggggtcacagctcaggttcccacacctcacttttcacagcctccaagggcagcagtgcacatggaggagacgtctcccacgaggccaaggcctccaatgctcaccgatgccctctgcgaagctggggtagaactcgtcagtgaagaggggctcaggcagctcacggaagtacagcttcagcgtgcctgcgatggcgttcatgtccgtctcgctcatcatcaccgacatgtccttcttatctggaaagagcacggaaatgcagcggcctccttgaagatcctgataaatgaagaaaagacacagagaaggatgtgacatgcctgggccatggagcactctgagatctcatcgcggacaccactgcccacacctccatcccgtcctgcgcaggccaacactcactgacatcgaaggctgccttcagtgcctggatgtctgcggccacaccggccggacacgtggtagatgcccacctcctccatgcctcggcgctcgatctcctccacgcactggcgcacgatgtagggcaccttggacctctctctcctgtgggaggggggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcttcacggcatgtgctttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaatccctgacccctgccctgggccttaacacacatccgacgaatgaatgaagggttgcctcagtaccggtgctccaagtcctgcgatgctaagtgcttttctcctctgagtcttagcaatggacaattccaatacctccacacaggacactagagtaagaaaccttcacagttagaacgcagtgctgtgcggaggccttaacttgagttctgttttgcacctggatttaccagcacatcaaagctgcttcgcaagccccctcattagcagggcttatctgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaacaggcttctcttggcaacagactcatgacaaaggattcaagattgtttgaaaaaaaaaaaaggggagcagggaggcagaaagtcctggaaaagtaaattgtttattttacaataagaaagtgattacatattttttttttttacaatggtggaaaattagaagtcattgtgaaaatgatgtctacctgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcagagattgcccccgctacactccagcctggtcgacagagtgaactctgtctcaaaaaaaaaaaaaaaagaaaagaaagaagaagccattcccaacgttgctcatcaaattatgaccataaatttccaggatcagactaacggctaaagagactgatgcatcaacaccaggcagagaataaagcagatttttttgttgttgttctggagagcttctaggaacttgaaaaatacatatgccacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagatagaaaaccctaaattaaaggtgaaaaaaccagacaccaagtggcatttaaataaatgtcaactttaactccacaaagcatctggttgcatgtggacagaaagagaaggaaagagggccctatatttggataacttagaaatgtgctccccctagcaagatatctaccaaaattaaaaccatatttgaggatgctggcactgcgagtaatatataaatgatgcatgtaacgtcatttaatatgatcttatttttaaaaatgaaaaaaaaa

SEQ ID NO: 2121 - DNA, 3685 bp, Homo sapiens
tgtcgtgtgagccttgctctcctggggaggctcaggctgacggctgatgtgggcattgccgagggtaacctgtggcccagtgtatatggccgggtctcctcaagctgcattcattcaagtaggacccagggtgcatgcccatctccagcccagggcagctcccctgtaagctgggtgagctactgaagccaaggtgggaggcagctgacaacaccacccacggcccatgcagaggtggtagaaaggctggactcagcaggaacaccaaatcccggaccaggcagaaaccacccaagactgaggggctcgtgccagagcggtggccacagagacttcagaacccactcctgagaacagcggagccaggcgcttagaggaagaccaaatgctgccaggacacggattgtccagggattacattccagcatcttattagaggacggaagcagagggtgctgtttcaacgccaccaccaggagagaggcagaggggctgtgccgtgctagagtcctcagggagggagtgacctcgaccctggctgtgctgcaagctgactccagccttgggctcagcagcacccggtgaacagcagcaggaggagccgctagagcagctgctcatgggcagagcagcccttgggcaactcctgccaccaccccctccccagggagcccaaggcaggggaggctcagcatggaatgaaacaggggagtgagggacacaaggaggtgggaagtgggagggtcccagccccaccaagtacgcagagaccccctcgtcgtcctggacaccacaggggcacctgcaggctgggagaccaggtcctctgtgcatgggcccgggaggcagacctgccccaagggtgatgcagaggccacaggtgctgcacgctccagcgcccactctagacatcagcctccaggttgactaagggtcaggtcatgtttgaaaccatgcttggctggaccgggacccatggcaagagcacctgggcaccagtgtttagccctggtctgcaggaaggaggacagcagactttaggaccccacagcatggcagtgctgaccatttcacccacttggcctccttgaggaatagggatggggagccctctggggatgagcaaggccttccaggacaggctcggttctggtcccctgctttttgaggttgggttaaaatgccgaccatggcagaggggtcacagctcaggttcccacacctcacttttcacagcctccaagggcagcagtgcacatggaggagacgtctcccacgaggccaaggcctccaatgctcaccgatgccctctgcgaagctggggtagaactcgtcagtgaagaggggctcaggcagctcacggaagtacagcttcagcgtgcctgcgatggcgttcatgtccgtctcgctcatcatcaccgacatgtccttcttatctggaaagagcacggaaatgcagcggcctccttgaagatcctgataaatgaagaaaagacacagagaaggatgtgacatgcctgggccatggagcactctgagatctcatcgcggacaccactgcccacacctccatcccgtcctgcgcaggccaacactcactgacatcgaaggctgccttcagtgcctggatgtctgcggccacaccggccggacacgtggtagatgcccacctcctccatgcctcggcgctcgatctcctccacgcactggcgcacgatgtagggcaccttggacctctctctcctgtgggaggggggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcttcacggcatgtgctttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaatccctgacccctgccctgggccttaacacacatccgacgaatgaatgaagggttgcctcagtaccggtgctccaagtcctgcgatgctaagtgcttttctcctctgagtcttagcaatggacaattccaatacctccacacaggacactagagtaagaaaccttcacagttagaacgcagtgctgtgcggaggccttaacttgagttctgttttgcacctggatttaccagcacatcaaagctgcttcgcaagccccctcattagcagggcttatctgggggagctgctgatggagtcctcgctgctcatgcccacagccctcccagagtgctatgcgattgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaacaggcttctcttggcaacagactcatgacaaaggattcaagattgtttgaaaaaaaaaaaaggggagcagggaggcagaaagtcctggaaaagtaaattgtttattttacaataagaaagtgattacatattttttttttttacaatggtggaaaattagaagtcattgtgaaaatgatgtctacctgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcagagattgcccccgctacactccagcctggtcgacagagtgaactctgtctcaaaaaaaaaaaaaaaagaaaagaaagaagaagccattcccaacgttgctcatcaaattatgaccataaatttccaggatcagactaacggctaaagagactgatgcatcaacaccaggcagagaataaagcagatttttttgttgttgttctggagagcttctaggaacttgaaaaatacatatgccacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagatagaaaaccctaaattaaaggtgaaaaaaccagacaccaagtggcatttaaataaatgtcaactttaactccacaaagcatctggttgcatgtggacagaaagagaaggaaagagggccctatatttggataacttagaaatgtgctccccctagcaagatatctaccaaaattaaaaccatatttgaggatgctggcactgcgagtaatatataaatgatgcatgtaacgtcatttaatatgatcttatttttaaaaatgaaaaaaaaa

SEQ ID NO: 2122 - DNA, 3642 bp, Homo sapiens
tgtcgtgtgagccttgctctcctggggaggctcaggctgacggctgatgtgggcattgccgagggtaacctgtggcccagtgtatatggccgggtctcctcaagctgcattcattcaagtaggacccagggtgcatgcccatctccagcccagggcagctcccctgtaagctgggtgagctactgaagccaaggtgggaggcagctgacaacaccacccacggcccatgcagaggtggtagaaaggctggactcagcaggaacaccaaatcccggaccaggcagaaaccacccaagactgaggggctcgtgccagagcggtggccacagagacttcagaacccactcctgagaacagcggagccaggcgcttagaggaagaccaaatgctgccaggacacggattgtccagggattacattccagcatcttattagaggacggaagcagagggtgctgtttcaacgccaccaccaggagagaggcagaggggctgtgccgtgctagagtcctcagggagggagtgacctcgaccctggctgtgctgcaagctgactccagccttgggctcagcagcacccggtgaacagcagcaggaggagccgctagagcagctgctcatgggcagagcagcccttgggcaactcctgccaccaccccctccccagggagcccaaggcaggggaggctcagcatggaatgaaacaggggagtgagggacacaaggaggtgggaagtgggagggtcccagccccaccaagtacgcagagaccccctcgtcgtcctggacaccacaggggcacctgcaggctgggagaccaggtcctctgtgcatgggcccgggaggcagacctgccccaagggtgatgcagaggccacaggtgctgcacgctccagcgcccactctagacatcagcctccaggttgactaagggtcaggtcatgtttgaaaccatgcttggctggaccgggacccatggcaagagcacctgggcaccagtgtttagccctggtctgcaggaaggaggacagcagactttaggaccccacagcatggcagtgctgaccatttcacccacttggcctccttgaggaatagggatggggagccctctggggatgagcaaggccttccaggacaggctcggttctggtcccctgctttttgaggttgggttaaaatgccgaccatggcagaggggtcacagctcaggttcccacacctcacttttcacagcctccaagggcagcagtgcacatggaggagacgtctcccacgaggccaaggcctccaatgctcaccgatgccctctgcgaagctggggtagaactcgtcagtgaagaggggctcaggcagctcacggaagtacagcttcagcgtgcctgcgatggcgttcatgtccgtctcgctcatcatcaccgacatgtccttcttatctggaaagagcacggaaatgcagcggcctccttgaagatcctgataaatgaagaaaagacacagagaaggatgtgacatgcctgggccatggagcactctgagatctcatcgcggacaccactgcccacacctccatcccgtcctgcgcaggccaacactcactgacatcgaaggctgccttcagtgcctggatgtctgcggccacaccggccggacacgtggtagatgcccacctcctccatgcctcggcgctcgatctcctccacgcactggcgcacgatgtagggcaccttggacctctctctcctgtgggaggggggaatgttctcagtgtcctaacagccctgcttgggccataacacaggagacctgctccctatctgcgcacccggaggtggggtgaggacggtgacgaaggtacccaggtctggggctgcacacagagccttctgcatgcctgtcctccctctgcaagctctgtcttcacggcatgtgctttctcaggaacctttcaagcggccagaacccctgcgaatcacacatgacctttgcgggaaggtcaggaggcctgtctaagtcaagtcagcacgggaagggcatctgacagattccaggcctggggttagcagcctgtgcccccggctgggaggtcagacccggtgttggtcctgccacccacgtgctgtgtgagaggagaatccctgacccctgccctgggccttaacacacatccgacgaatgaatgaagggttgcctcagtaccggtgctccaagtcctgcgatgctaagtgcttttctcctctgagtcttagcaatggacaattccaatacctccacacaggacactagagtaagaaaccttcacagttagaacgcagtgctgtgcggaggccttaacttgagttctgttttgcacctggatttaccagcacatcaaagctgcttcgcaagccccctcattagcagggcttatctgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctggggaagcaaatgaattctcagaggaagtggtctgtgtctgcatgaactgctctcaaaccaacaaacaggcttctcttggcaacagactcatgacaaaggattcaagattgtttgtacaataagaaagtgattacatattttttttttttacaatggtggaaaattagaagtcattgtgaaaatgatgtctacctgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcagagattgcccccgctacactccagcctggtcgacagagtgaactctgtctcaaaaaaaaaaaaaaaagaaaagaaagaagaagccattcccaacgttgctcatcaaattatgaccataaatttccaggatcagactaacggctaaagagactgatgcatcaacaccaggcagagaataaagcagatttttttgttgttgttctggagagcttctaggaacttgaaaaatacatatgccacactcttaagacccggtggttcttaatcagggatgttcattaaaatgctggaaaactgtaaagacttccaggtcccatccaaggagattttgcttctgattgactggctagtggcctggccattggtattttgaaaaatccctccaagtgattcttttacatcccagatagaaaaccctaaattaaaggtgaaaaaaccagacaccaagtggcatttaaataaatgtcaactttaactccacaaagcatctggttgcatgtggacagaaagagaaggaaagagggccctatatttggataacttagaaatgtgctccccctagcaagatatctaccaaaattaaaaccatatttgaggatgctggcactgcgagtaatatataaatgatgcatgtaacgtcatttaatatgatcttatttttaaaaatgaaaaaaaaa

SEQ ID NO: 2123 - DNA, 470 bp, Homo sapiens
agcccggatgtaccctcatgcgcccttttctggttggctggccggcagagtcccagcatccaccgagtgctcagggcgggtgggaggtagagcagcatgtggctgtgtgcccacatccctgggagacaaggattgtcaggcagcatcagggaaaatggtatgtggggagatgattctgttgtaaaaggcggttctataaaacaatcacaatttggattgttatcaaggagagaaaggagcctctggttgaaccagagaggtgggtctgactcagaagtgtttcccagcctgccttcacacacctgcggctgttcggggcccgtgatggaaccaggagcagggagcgtggatagcatccttaaaagtccgccagttgggaggctgaggcgggcggatcacgaggtcaggagatcgagaccatcctggctaacacggtaaaaccccgtctctactaaaaatacaaaaaaaaa

SEQ ID NO: 2124 - DNA, 508 bp, Homo sapiens
acaacagcgtatgcaactagaggacacgacgatgccaccctctttgtcccagggccacagggcatagatgagatcaccatgacacaacgacaccaccttctctggcctcctaggtaaagagtctgttggctcaagccggactctcccttcctcttaaagcccactcctgccctttgtcaggaagcctccccgagttctccagccaggtggtggcagccctatgaccacagccctggtctgtgcactctcagctaaagcttgctgcccccaccctggtctccaccaaactcacagagaaacctacagggcagtccagctgtgcaaatatctccccaatgtgtctcttctatggaagcagagaaggcttgacagccatttgttatttacttgcgtatgagattcctgtggctgctgtgacagattaccacacgcttagtggctgaaaacaacacaaataaattctcttctagttctgaaggtcagaagtctgaatgggttttaccagcta

SEQ ID NO: 2125 - DNA, 354 bp, Homo sapiens
tatacactgtccataagatactcactttaacttaaggacacacataaactgcactgaaaggatggaaagagatatgccatgctaactgggcacagtggctcatgcttgtaatcctagcactttgggagaccgaagcaggcagatcagttgaggccaggagtttgagaccagcctggccaacatggtgaaatcctgtctctactaaaaatacaaaaattagctgggcatggtggcagatgcctgtaatctcagctactcaggaggctgaggcaggagaattgcttgaacctgggaggcagaggttgcaggagcactgcactctagcctgggcaatagagtgagactccatctcaa

SEQ ID NO: 2126 - DNA, 748 bp, Homo sapiens
aacctgcacgttgtgcacatgtaccctagaacttataataaaaataagagcaaacaaaattacttgaatcaatgagaaaacattagaaagaataatagatagccagggtcatcagatatttgaggaaaatataagagaaagagaaaaaataagtaaagagaccacagataggcaggcttctaatgaatatataatagaacagataagagattaaacttagaaatacagaggtaaatagacagatcaaaaagatttaaaagttgttgcttttgggcagcagggctgaggtgaatagaaatggaaagggaattgctgggttttgtcataaccttttactactatttgattgtttaactgattttatttattagattaataaaaatattaaagagtaaaggccatggatttttaagccctcaaaacattttaattgtgcatatttttatcatatagatgcttcttattagaaaaaactttccattctgttacattaatttttatcatgtgttgccattacattaccgctgttcttaaagacctcttcctgtttttgacctcactgttgagctgaattaaatacacgttatcatctaactagttttaactttaagaagtaagatatgttctgagaaaagtattctttaacaggttccaatcgttcttaaagattcatagaactttatacatggtgcccaaatgtcttttctgtctatgttaataataagtaaaactattgtttataaaatgc

SEQ ID NO: 2127 - DNA, 819 bp, Homo sapiens
aaaacaaaaaaaaaaaaaaaagaaaaagaaatgcaaagctttattttatgagtcagaggacttgatactaagtcttaagattgtaatactgcccctgccaagttaatctgcaaattcaacaaattcaaaaaaacaaaaacctccactcccagatacctttttgcaaaaattgacaagttgatcttaaaatttatgtggacccagagtagccaaaataatcttgataaataacatatttggagtactcactcggatatcaaaacttagggcaaaactacaattataagacaggcataaagataagcgaaataaaagtccagaaataaacccttgtgttttgtagtcagttgatgtttggcaaaagttccaagacaattcaaatgggaaagaatagtctcttcaacaaatggttttgggacaagtaaatattgacccctcctttatgcgatatacaaaagttaaactcgaaatgtaacaaacacctaaatataagaattaaaactataaaactctaagaggaatatctaagggtaaatcttcacgactttgggttacacaaagccttgttgatgtgacaagtcacaaaagaaaaatagatgaacaccaaatataaaaacacttgctgcaattgataccaacagattagaataacaactcagaattggaaaaatatttgcaaatcatatatctgataaaatgtatccggaatgtgtagagaattctttcaacccaataaaaagaatataaatacccaatttaaaaaatgagtaaaggggccgggcgcggtggctcatgcctgtaattccagcactttgggag

SEQ ID NO: 2128 - DNA, 381 bp, Homo sapiens
acagagcgagtcgaccttctcaaaaaaaaaaaaaaagtccccatttcacagatgtaaaaattaaaacttggagagatgaattgacttgctaaagacacacagggctgggtatggtggttcacacctgtaatcccagcattttggaaggccaaggctggtggatcacctgaggtcaggagttcaccagcctagccaacatggtgaaaccccatctctactaaaaatacaaaataagccgggcatggtggcgggtgcctgtaatcccagttacccaggaggctggggcaggagaatcgtttgaacctgggaggcagaggttgcagtgagccgagattgcccctttgcactctagcctaggcaacaagaacgaaagtccgtctc

SEQ ID NO: 2129 - DNA, 452 bp, Homo sapiens
gtcttttttagttccatatgaattttagaatagttttttcctaattatgtgaagaatgtcattggtagtttgatagcaatagcattaaatctgtaaattgctttgggaagtatggccattttaatgatattgattctttctatccatgagaaaattgcctagtttttaaaatggtactcagcacaaagatttcaaaagtattttgcaaaggaaggtgaggctgatgactacccttagagatctacagctattcaccatctcttactcaatgtagtttgtggacagttgcatatatcagtggcatggttgcatggatgcagtaggccataagtgaaacagaagaaacattttgtgtaaaataataatgaataagaaacatcacttccttcattctaggtctctaatcaacacagtcatcctgatctttgtagtcctatattggttcttcttag

SEQ ID NO: 2130 - DNA, 493 bp, Homo sapiens
atcctcttgcttcagcctcccaagtaactggggctacaggcgtgagccactgcacagtagttaagatcgcagctctggagggagttactagcagttgtaactttgacagctcgtttaaccttcctaagattgtgtttcctgtctcttgagtaaaatgaggacaaatttgtctcactgtcacagaggatagaatggagacagtggaactaagagaaggtggcacatgctagctatgctcaacaaatgtcagcaaattttgttgaaatgtggaagatactgacaagagcaaagttttcagatcagcaccagtaacttgtcttacttaaaccgttaaaatcacatctgttttgatttttcccctttttctcttttgagccttttattggaagagcagatgcagtctgtgcgggtatgcagtgctgcagtacgaagtgaatggcaccccctgggagttggggcagtgcacaacgcttcagtgccttacgtagggagg

SEQ ID NO: 2131 - DNA, 356 bp, Homo sapiens
attgagttgtgatctcgttttatagtaccaaacatatgaccacttcctcatcattctttaaaaagtatgctattttaatatttttaaagagcctttgtgtgctcactggtttcaaaaataaaatctgcatgattccatttaagaagtgtttgtgtttggagtgctatttttagagaatttttgtctctgctgattctgacaggttggcccttcctgaacgtggggccattgcctggaagtcaggaggcccgggacttggtgctgggtctgctgtcatttgccatatgaccttccttgggcaaatcccttcccttattctggcctctaattccttatatgtgaaatgagtgggttgt

SEQ ID NO: 2132 - DNA, 742 bp, Homo sapiens
aggctgcaggcagttgcgggttgcaggagttcaggaaaggaggtgggactagagtcaacctggaatagctctacagtaacaatggcagcctttttgttgctgggacatccatacaggcaacttagctggtgaaaggactctggattggttggcagtctgcttttttttttccaaggtgatcactttactgtagaagaaatgaggttaacagaaaagagtgagggagaacaacaactcaagcccaacaactctaatgcacccaatgaagatcaagaagaagaaatccaacagtcagaacagcatactccagcaaggcagcgaacacaaagagcagacacacagccatccagatgtcgattgccttcacgtaggacacctacaacatccagcgacagaacgatcaaccttcttgaagtccttccgtggcctactgagtggattttcaacccctatcgattgcctgctctttttgagctttatcctgaatttcttctggtgtttaaagaagccttccatgacatatcccattgtctgaaagcccagatggaaaagatcggactgcccatcatactccacctcttcgcactctccaccctctacttctacaagtttttccttcctacaattctttccctttctttctttattcttcttgtacttctgcttctgctttttattattgtcttcattctgatcttcttctgattcttttgtttcaataaacagcaatgagcatgaacac

SEQ ID NO: 2133 - DNA, 470 bp, Homo sapiens
ctagaaaagtaatacacctaaaaaaatgtctgattctaaatactggttttaacctcactactatgctgccattctatacttattttgaaactttaaaaagaaattgtaatgacaagagtattcagttatttaagaaactattgttttctttaattggtctgtgattacatgcatggaagtttcaaaacatctgaaaagcttcagtgtggacaaagcacaactgatgcttttgacattttgtccattttgttagaattcagcagccagctaaacataataggaaatccaatagagcttgagctgtagctgcaaaagccttttttttttttttttttttttttaatcatcttgtgaaattctactgcaggccatcaggggattgccaggcagtccttgcaatagcaagataatgaggcaaggccagagtgtgtctataatcccagctactctgaaagcagaggcaggattgc

SEQ ID NO: 2134 - DNA, 348 bp, Homo sapiens
gcatctgaaagggttaataaggtgcccctatgcccgcccaggccatttccctgatggttcctgggaaggttttctgtgtcccctcctcgtgacccggcgggtaaacaaacacagttcccactgacattagtaggatgaagcagatggtttcctctccaagtgtttattcagtttatgtattttcattagcagtgtttctataggaagagcagaggaaataagacacagccatttttattttttatttttatttttattttttgcttcttttgagcagccctggtaaaaaaaaatgcttggggaagatgctcacaggtgacaaaaaagacacctagtgcctgtcgaagg

SEQ ID NO: 2135 - DNA, 468 bp, Homo sapiens
ccaggttgaaccattatttcctcatttgctttaaaaacggatacattgttggtgtggctgctaaaaagagagcaggcagctggggctccgggaagtacctgtgcagggcagttccgcctccccctcttggctggctcccgacttctctgattcttgccaaccaagtcctgctaactaaactcctaagagactgactgataaatcatttattcattcaacaaatacttgagcacctgtttggttgcaggcaccattccaggccctgagaatgtggcaaggcactgaaacaaacccctcctgtatcttacattctagtgggggttggggggacagatgataataaaaataagaacattcagtggcttatgcctgttatcccgcactttgggaggctgtagccaaaggatcagttgagcccaggagttcaagaccagcctgaccgacacagtgagacccccatctcttaaa

SEQ ID NO: 2136 - DNA, 398 bp, Homo sapiens
aaagccagaaacttggagttgaaagagatgcttctgaaatgccatgtttctccataagagtgggcaagggagccatctggtggaggaagcatgcttagacattcccttctctcttccctgatttctccagcctgttctcctcagcatttccacctagtatttctccaagggccacagtgaggtttatgagtcaagtatgtgggccataaacacacttgcttattgaagcaaatactaacctctgcaaaatgtcaaggtaagatattatcttcagtgattatttaattttctcccttagtctcttctacctgtctgctaccgaggggaaaacatcagcagcaccaggagttgaggcagaatgctgcaggagggaaagaaggaactagaacttgattatg

SEQ ID NO: 2137 - DNA, 159 bp, Homo sapiens
gttagttacaccagtggaatttgggaagagaaactcaaatcgtaatcttacaatcagagtcttcctgccacatgtgaccatttgattcattgtcaaagtgtatagagaatgcaagctatttccatatgctaacccaattttctcctcccccaaccccaa

SEQ ID NO: 2138 - DNA, 436 bp, Homo sapiens
tgcaagttgaagtttatcaactacatatgttatgtaattgtattatatttcacaatatatttagttactggtttatagatttggaatggtttcattgaaatgtcctgaaaagcaaaatgggtttgtttgtttattgattgattgattgattgattaagacagagtcttgctctgtcacccaggccagagtgcagtggcatgatctcggctcactgcaacctccacccacccagttcaagtgattatcctgcctcagtctcccaagtagctgggattacaggtgtgcaccaccacacctggctaatttttgtagttttagtagagacagggtttcaccatgttggccaggcttgtctcaaactcttgacctcaagtgatctgcccaccttgacatcccaaaatgctgggattacaggcgtgagccaccgtgcctggc

SEQ ID NO: 2139 - DNA, 240 bp, Homo sapiens
gacaatgaaggagggaggtgaccagtatcaatcacagccctgaaggacacactggagctgaagccttctagctccagtgtgtcctctaactttcatcttacagcttcccctcaataggagaggccaccagaattctggcggaactgttccctgaatgcacgtggatagatgaatatggatgttcacagtagagttctgcagtgggcctggagacgcactgctcagatccccttcattaag

SEQ ID NO: 2140 - DNA, 429 bp, Homo sapiens
  misc_feature (39)..(39): n is a, c, g, or t
ttttggagagagccccttgggaaacccaccctcttcccnactcactgtcccttgccttgcaaggaacagatccctccccagctccttaaaggcagccgcatcaggagcggcactcacagcagaccatcccctaggcccagaggggtctagggttggtgcacggccccaggcaactcggggagcttccatgcggggctttatccagaactcccgaaaagaaggcatttctcctcaccctagagggcaggagccgggctgttcttaccaccggaaagcacaagcctccctcagactaaagcagaactgcaagaagaggagactccatcccaagaacggggttcggctcctggattccaccacgcccagagcccgggattaacctccaggcttttccatcacataagccaataaagtcacttttttgtttca

SEQ ID NO: 2141 - DNA, 401 bp, Homo sapiens
cctccttgtttgctgcaatggatttgggctgtgttttgtggagttttgtgttttgtggagttctctgcattttctgattgattgcatctccttgttgtcattggggctttctggaagctggtggttgcatctagacccagagagggtcagttcccactggtctgctgtgctgctcctgcaccaggctcggcattggctgttgctggatccctgtcacgtgagtgtgagctgggtaggcctcgagccagccctcaggacatgagcctctgccagcttccttgatttgggccgcgccgtgctcctgggactgcaggcgtgagcgctcgcgcccggcccctgccagcttccctgatgtgggctgcgccgtgctgtcccatcttcatctctgcatttcccacctg

SEQ ID NO: 2142 - DNA, 302 bp, Homo sapiens
gccacaacatgtacagtaagcatgtcttacttttatactataccgcaaaattatttttaaaaggttaagctataatgtgtcacgtcaggcctgcagaattttgttcattttaagaaaggatatgtttttaagatgacaagcaaagaaacaggagaattcattataaagtatctggactcaaggcaatacttgcattaaagaagaatcatcgaccaggcatggtggctgatgtgtgtaatctcagcactttgggagaccgaggtgggtggaccacttgaggttaggagtctgagaccagcctg

SEQ ID NO: 2143 - DNA, 518 bp, Homo sapiens
gcgtcgacagcctccggggttgggggtaagtagaagggggtgaggggccagcactagttgactcaaggcaccctggtggggacggagaggttttttcgctcagtggtgcaggccatcaggcaggggtgtccaggcagggcccgggtgcaagaaaacattctgtgtgcgctagtgcgagaggatcttctacagtcacctgccttcatgccattacagacagacgggaagtcactgggttctaggacataaaaagacctacatgttggctagcctaaatcgaacccttttgtagtaataaagattcatcaatgttttaaactgtcccctgtcagccccctgggactcaggtgaaccaactctctttgggaatctatcttagaagatgaaaccataaagccttcagtttcagtgtcagggatgcacactctatatctggtgaaattatggaggggtgaaaacttctgtacagcaaactgtacctccaaatctttaatgtcgaaataaagggctttttgcca

SEQ ID NO: 2144 - DNA, 504 bp, Homo sapiens
gcgtcgacagcctccggggttgggggtaagtagaagggggtgaggggccagcactagttgactcaaggcaccctggtggggacggagaggttttttcgctcagtggtgcaggccatcaggcagggcccgggtgcaagaaaacattctgtgtgcgctagtgcgagaggatcttctacagtcacctgccttcatgccattacagacagacgggaagtcactgggttctaggacataaaaagacctacatgttggctagcctaaatcgaacccttttgtagtaataaagattcatcaatgttttaaactgtcccctgtcagccccctgggactcaggtgaaccaactctctttgggaatctatcttagaagatgaaaccataaagccttcagtttcagtgtcagggatgcacactctatatctggtgaaattatggaggggtgaaaacttctgtacagcaaactgtacctccaaatctttaatgtcgaaataaagggctttttgcca

SEQ ID NO: 2145 - DNA, 537 bp, Homo sapiens
gcgtcgacagcctccggggttgggggtaagtagaagggggtgaggggccagcactagttgactcaaggcaccctggtggggacggagaggttttttcgctcagtggtgcaggccatcaggcagggcccgggtgcaagaaaacattctgtgtgcgctagtgcgagaggatcttctacagtcacctgccttcatgccattacagacagacgggaagtcactgggttctaggacataaaaagacctacatgttggctagcctaaatcgaacccttttgtagtaataaagattcatcaatgttttaaactgtcccctgtcagccccctgggactcaggtgaaccaactctctttgggaatctatcttagaagatgaaaccataaagccttcagtttcagtgtcagggatgcacactctatatctggtgaaattatggaggggtgaaaacttctgtacagcaaactgtacctccaaatctttaatgtcgaaataaagggctttttgccatttctgttttcagttcaaaaatacttgttgctg

SEQ ID NO: 2146 - DNA, 407 bp, Homo sapiens
taaaagtgtggagaaggggccaggagaggaaacaacatgacaaggagtttataaatctaaaggatgactttcttgctgcatgtaactagtatgtgactgcttctgcattcccttcgatctatccttggctttctcaatgtgaatatttttgttctaaaaattgggaccaaatctggtcctctcaaggagaagtaagaagaaccccaatgtctttcttcttccagctaatttaaaataattggatttagccaggtgtggtagtgcatggctgtagtcctagttattcaggaagctagggcaggaggatgcttgagcccaggaactccaggctagtgcactataactgcacctatgaatagccactgcactccagcctgggcgacagaggcgatccgtctcaaaaaaaa

SEQ ID NO: 2147 - DNA, 295 bp, Homo sapiens
taaacaaactcttggcaatctgtggtttatttaagtggtattagtcaatgtggtttcgtgttcttttccagttcagttcagcagaggcgctatcactgaataagtacagaattcagtttaactaaaggtgagatttctctaggtgaataaaacagtcagtgatgagatgttcatacatttaggagaatgattataaaagagggatatggaaagtaatctgggttaaggagtgaagtgagaaaataaagaaggttgagacagtggaaaatggtatcatcaattgtagattgcagtg

SEQ ID NO: 2148 - DNA, 204 bp, Homo sapiens
cctctatatcactctgtgatgctcacaaatatgttttcttaaatcctcacacaccataggagcttttcaatgatatttgctcctgttcttctgaataacagtagaaatgattgaaattcaacttgttaaaaatataccttagaaagtagaggatgcctttgggcgtattttacttcctgcacaatagcatttattttatgattc

SEQ ID NO: 2149 - DNA, 335 bp, Homo sapiens
tttttgacggagtctcgctcagttgcccaggctggagtgcagtggcgcgatctcggctcacggcaagctccgcctccccggttcacgccattctcctgcctcagcctccccagtagctgggactacaggcgtccaccactacgcccagctaatttttttgtatttttagtagagacggggtttcaccgtgttagccaggatggtcttgatctcctgacctcgtgatctgcccgtcctggcctcccaaagtgctgggattacaggcgtgagccactgtgcctggcccaagaatgactagctttaagaaattctgccctagcctttaacaagctatg

SEQ ID NO: 2150 - DNA, 1005 bp, Homo sapiens
gtgatcctcctgcttcagcattctaaagcactgggattataggtttgagctaccatggctggcctaatcatattaattttaagtaaaatgttctaacttgattaagactggatgcctgagtaaacaatggttttgaatttccacacctgcatttcacaacaggaatccaagctcagccaattttattccattcttcaaggcacaagatatttctgaattataaacattagatataataggtgtataaggagaagtcatcttacatactaattctataatcatttaagctatagtcaaagcgaaattatacaaatgcagaagctctctttctctacccaactcaccaaatcttggattcagaggcaaaagagaaaaggaaagcacaaaaagaattgcgaaagaggaaaagcagaatgggcaaagacagtgtaaggaaaatggaggtgtgggaaatgtggagcttcactgttgcaaagcatgctacacataaagtatgaatggctgcctgaggagccactgctctagaaggctggctattactgttatgagaacaagcaccataccccatccaccttgtgtgtttggtacgtttctttcttccctgtacttggagttgctgggatgctgctgatgacctctccacctgccacgttaagtccttccaacaaatcaactaaactggaaatgttttaggccgagttcatactccaggatggctaaccctctcttctaccatcttgtactagaccagaagaatctttccaaatattcagaaaacactactctgcatggttacaactctcatcttgggcatttataatgcctaatagaactgggccccaaacactgcatcctgtcactgtgtgcaaacctctttggttactccaacttgagtccataaaataaatacttcatgttctgtaaaatgaatagagtgactgcctttatcaattttatggaattaaaattgtagaacagaataaagcctgttgtattagaactggg

SEQ ID NO: 2151 - DNA, 2882 bp, Homo sapiens
tgttttactccatttcccatcataaggcccattacaggcagctttgcagccttcttcaaattcctcatgccgcagaaccttcatccccaggacgtcccgatagaaacgcgccgtctggaagcggtttcccactttgaatacgaagtgcagacgtctgcgagcagccatgattcccaggcttaagtgatcctttttaagaagatttattcctctatgatggagaagtatgaaaaaattgggaaaattggagaaggatcctatggagttgttttcaaatgtagaaacagggacacgggtcagattgtggccatcaagaagtttctggaatcagaagatgaccctgtcataaagaaaattgcccttcgggaaatccgaatgctcaagcaactcaagcatcccaaccttgttaacctcctggaagtcttcaggaggaaacggaggcttcacctggtgtttgaatattgtgaccacacagttctccatgagttggacagataccaaagaggggtaccagaacatctcgtgaagagcataacttggcagacactgcaagctgtaaatttttgccataaacacaattgcatacatagagacgtgaagccagaaaatatcctcatcacgaaacattccgtgattaagctttgtgactttggatttgctcggcttttgactggaccgagtgactactatacagactacgtggctaccaggtggtaccgctcccctgagctgctggtgggggacacgcagtacggccccccggtggatgtttgggcaattggctgtgtctttgctgagctgctgtcaggagtgcctctgtggccaggaaaatcggatgtggatcagctgtatctgattaggaagaccttgggggatctcattcctaggcaccagcaagtgtttagcacgaatcagtacttcagtggagtgaaaattccagaccctgaagatatggaaccacttgaattaaaattcccaaacatctcttatcctgccctggggctcctaaagggctgtctccacatggaccctactgaaaggctgacatgtgaacagctgttgcatcacccatattttgaaaacatcagagaaatagaggatttggcaaaagaacacaacaaaccaacaaggaagaccctaagaaagagccgaaagcaccactgctttacagaaacatccaagttgcagtacctaccccagctaactggcagcagcatccttccagctttggataataagaagtactactgtgataccaagaaacttaactaccgttttccaaacatttaaaggagctaggagacatgattttaaaaaaggaatcaatagatgctttgaagaaaataaaacttatacagttgattgaaaacaattacaatgttgaaaacacaccaggagaaaacataagcaagaaactgggaggccaactggcaagatatgaagggaaattccagatccagtcttccatgcttgatgatggtgtccagaaaagaaaaaacctgtttggagttgcacttgtatttcagtttatgtaagtagccgaacttatggacagaatatgaactgtcccatacctctggcaaaactagatgatatcaaaaagatttatgcttcagttgtaccacatgccacacaagaaaaatgaaccacaaaatgcccatatatatttcctcggatctctgttgcctgagtcctatctcctgcctctcagattgtttcagcatcatatttaagatagttctatttcttgaaatcaaaatgtttaaaatcccatttcctgcttgctctatttcttgatttttatattttaaaacattttgagggtaacacttaggttcaaaatatttaaaagcatatgaattatcacaaaagcttggtaatttataatttaattatatgtttccacatttcatccttactttatcagtaaaggatacaccttagtcacttttgcaggcaacgtggatttactgtaatctgtctacatttattcacccaattccccttgtaaacaatggcatgaagctcggcagctgattaaggcagtcaaagggtagagcaagacctacaggctttgcaggaactgaacctatcagcctgaaaataattagtatttcattctctctggcacagcctttgacctggtacatctataggcaaacctgtaattcagtgatctgggtttcagaagaaattacttgtgagcttttacttgagtcatgaaagacattatgttgtaaactgatgttttccctgaaacatctttttgcactatgtttgtatgtgtatgtatgtgtatgtatatatatatatatatatatatatatgctattctaacaactaatatattacactaagtagtccaaagtattgaggactcatagctttgcacagtgagacttaaaatgatgacacacacacacatatatatatatgtgttttttatatatatatataaaacctgccacctcagcctcccaagtagctgggactgcaggcatgtgccactatactggctaatttttttgtattttttggtagaggcagggttttgccatgttccccaggctggtcttgaactcctgggctcacgtgatctgagcgccttggccttccaaagtgctggcattacaggcatgagccactgcgcctggccaaaatgacataattagctttgatttggtctactgctcttaatcaaaaagctttttcatccttgtcccctggacacaagggcaatatgaagcctgacgtctgtttcttacagctcaacaccatttctggttgatgtgctgccactattcctagcacttctcagccatggtcttcaaagttgtatttcactctattttcaaaacatttcttctgtactctcattttct

SEQ ID NO: 2152 - DNA, 2407 bp, Homo sapiens
gaggacaatggctgaaaaatttttttctagaaagtaaaagtactaaacagttccctttttagggataccgaaggacatatagtgcaatacaaaaaatacaggtgtgttctttcatttgacattgacaataaattcaaacattttcaggaagcttgaaggaagcagtttgtcttttttctttagagatggggatcttgctatgttgcccaggctgctctcctgggctcaagggatgctcccactcagcctcccttgtagctggaactacaagtgtacactgtgccatgcttgatttgcctttttaactaagggaagagagtgagtaggcaaattgcctaggtgctctgtttatcagttttctccgctataagacaaggcattggcttaaatgatccctaagatctcagcaagctctcaactcctgtaaatctatgttttcttcccaataatgttaacatgtagattttccccttttcatattctctaaatcttctttaatgtgaatgtttttcctttttaatataaacatttaaaaggaaaagccaagacgaaattgaaacatttaatcctctctcaagtcctggattgtgtgcaaaaaaagtacttctatactaaaaagcttaattacctcttttgtgatatattctaaataatgaaaaaaatgcatggcacagttttgaacctaattctgtgttttgcatttttagttgcagtacctaccccagctaactggcagcagcatccttccagctttggataataagaagtactactgtgataccaagaaacttaactaccgttttccaaacatttaaaggagctaggagacatgattttaaaaaaggaatcaatagatgctttgaagaaaataaaacttatacagttgattgaaaacaattacaatgttgaaaacacaccaggagaaaacataagcaagaaactgggaggccaactggcaagatatgaagggaaattccagatccagtcttccatgcttgatgatggtgtccagaaaagaaaaaacctgtttggagttgcacttgtatttcagtttatgtaagtagccgaacttatggacagaatatgaactgtcccatacctctggcaaaactagatgatatcaaaaagatttatgcttcagttgtaccacatgccacacaagaaaaatgaaccacaaaatgcccatatatatttcctcggatctctgttgcctgagtcctatctcctgcctctcagattgtttcagcatcatatttaagatagttctatttcttgaaatcaaaatgtttaaaatcccatttcctgcttgctctatttcttgatttttatattttaaaacattttgagggtaacacttaggttcaaaatatttaaaagcatatgaattatcacaaaagcttggtaatttataatttaattatatgtttccacatttcatccttactttatcagtaaaggatacaccttagtcacttttgcaggcaacgtggatttactgtaatctgtctacatttattcacccaattccccttgtaaacaatggcatgaagctcggcagctgattaaggcagtcaaagggtagagcaagacctacaggctttgcaggaactgaacctatcagcctgaaaataattagtatttcattctctctggcacagcctttgacctggtacatctataggcaaacctgtaattcagtgatctgggtttcagaagaaattacttgtgagcttttacttgagtcatgaaagacattatgttgtaaactgatgttttccctgaaacatctttttgcactatgtttgtatgtgtatgtatgtgtatgtatatatatatatatatatatatatatgctattctaacaactaatatattacactaagtagtccaaagtattgaggactcatagctttgcacagtgagacttaaaatgatgacacacacacacatatatatatatgtgttttttatatatatatataaaacctgccacctcagcctcccaagtagctgggactgcaggcatgtgccactatactggctaatttttttgtattttttggtagaggcagggttttgccatgttccccaggctggtcttgaactcctgggctcacgtgatctgagcgccttggccttccaaagtgctggcattacaggcatgagccactgcgcctggccaaaatgacataattagctttgatttggtctactgctcttaatcaaaaagctttttcatccttgtcccctggacacaagggcaatatgaagcctgacgtctgtttcttacagctcaacaccatttctggttgatgtgctgccactattcctagcacttctcagccatggtcttcaaagttgtatttcactctattttcaaaacatttcttctgtactctcattttct

SEQ ID NO: 2153 - DNA, 684 bp, Homo sapiens
agccatcagacttggcctgagtggattataggcatgagccaccgcacccagccagctacctttttataaatcacactataaatgccaaaaattattctcaggaaaggcaagttatataacttgagcccccccaccccctcaaaaaaaaaactgctcagaaaagttttttttcattagtatttttatttataatttgctatctccattggtatcagagcaggaagttaagggagtagttacgaagcaaatttggaaaagcgatttggaggtggggagagaaagcttgtgaaaaaggcaaagggagactgttttgggcaggaggttgggtgggcaaagggtggaggacgtgaggaaggtgccaggaaaatgtttctatcaaaagatttaatttgaggtaaccttaatttgaatacatgctgtaaattaaaaacctcttttcttttcaacaggaaccacttgaattaaaattcccaaacatctcttatcctgccctggggctcctaaaggtaaaaatcatggcttccaacagaccaggaagcacacagcagttgtcatcactggggaatctgaattacttatgtcaatccatgcaatgaaaagtgttccttttagaattcttctcctggctgggcagtggctcacacctgtaatcctagcactttgggaggccaaggcaggcagatc

SEQ ID NO: 2154 - DNA, 603 bp, Homo sapiens
actgaagtttcatctttcaaagaagaaaaaaatgacattaataagttaatacaattttgaagaagtaagaagaaggaattttctgttcttttagggctgtctccacatggaccctactgaaaggctgacatgtgaacagctgttgcatcacccatattttgaaaacatcagagaaatagaggatttggcaaaagaacacaacaaaccaacaaggaagaccctaagaaagagccgaaagcaccactgctttacagaaacatccaaggttataatttgaaatgatctcctacctgccacctggtacagagagttggaatctagacttgaggatggcagttgtggctttcagctccagcatcctcattccagcactaggagacaggtcataggatctatcaaccagggccccagggacatctgtctcctgaagccccctctccctgaatcctaaaggtgcccttgtcctgctgcttcctgatgccacacaggggccagggtttctagcctgcatgagcacaggtctcaacaaggtacatgagtatgagtccagctaaggagactttttgggctttggaaaataaaatcagattttccccatgcagt

SEQ ID NO: 2155 - DNA, 2690 bp, Homo sapiens
atttgaatttcagataaacaagcataacttttagtataagtacatcccaagtgcttcatgggatgtattatcctaaaaaaattatttgtttatctgaaattcaaatttaactgggtgtcctgtatttttctctgctaagaccggctaccctactttcattttcctttcactcttcttggctcttttgggccttttaggaatttgggatgattcaggctctgacaggcatggtactagatttattttaggctgctcttttgctgttgtccaacaggccaaggagagatttaaatgatttatccaatatttgctaaatagtcatgtgtttcatttatcccatatatagttcagccttaatattgtttttgttttgatttgttacactagtgcatacatagagacgtgaagccagaaaatatcctcatcacgaaacattccgtgattaagctttgtgactttggatttgctcggcttttgactggaccgagtgactactatacagactacgtggctaccaggtggtaccgctcccctgagctgctggtgggggacacgcagtacggccccccggtggatgtttgggcaattggctgtgtctttgctgagctgctgtcaggagtgcctctgtggccaggaaaatcggatgtggatcagctgtatctgattaggaagaccttgggggatctcattcctaggcaccagcaagtgtttagcacgaatcagtacttcagtggagtgaaaattccagaccctgaagatatggaaccacttgaattaaaattcccaaacatctcttatcctgccctggggctcctaaagggctgtctccacatggaccctactgaaaggctgacatgtgaacagctgttgcatcacccatattttgaaaacatcagagaaatagaggatttggcaaaagaacacaacaaaccaacaaggaagaccctaagaaagagccgaaagcaccactgctttacagaaacatccaagttgcagtacctaccccagctaactggcagcagcatccttccagctttggataataagaagtactactgtgataccaagaaacttaactaccgttttccaaacatttaaaggagctaggagacatgattttaaaaaaggaatcaatagatgctttgaagaaaataaaacttatacagttgattgaaaacaattacaatgttgaaaacacaccaggagaaaacataagcaagaaactgggaggccaactggcaagatatgaagggaaattccagatccagtcttccatgcttgatgatggtgtccagaaaagaaaaaacctgtttggagttgcacttgtatttcagtttatgtaagtagccgaacttatggacagaatatgaactgtcccatacctctggcaaaactagatgatatcaaaaagatttatgcttcagttgtaccacatgccacacaagaaaaatgaaccacaaaatgcccatatatatttcctcggatctctgttgcctgagtcctatctcctgcctctcagattgtttcagcatcatatttaagatagttctatttcttgaaatcaaaatgtttaaaatcccatttcctgcttgctctatttcttgatttttatattttaaaacattttgagggtaacacttaggttcaaaatatttaaaagcatatgaattatcacaaaagcttggtaatttataatttaattatatgtttccacatttcatccttactttatcagtaaaggatacaccttagtcacttttgcaggcaacgtggatttactgtaatctgtctacatttattcacccaattccccttgtaaacaatggcatgaagctcggcagctgattaaggcagtcaaagggtagagcaagacctacaggctttgcaggaactgaacctatcagcctgaaaataattagtatttcattctctctggcacagcctttgacctggtacatctataggcaaacctgtaattcagtgatctgggtttcagaagaaattacttgtgagcttttacttgagtcatgaaagacattatgttgtaaactgatgttttccctgaaacatctttttgcactatgtttgtatgtgtatgtatgtgtatgtatatatatatatatatatatatatatgctattctaacaactaatatattacactaagtagtccaaagtattgaggactcatagctttgcacagtgagacttaaaatgatgacacacacacacatatatatatatgtgttttttatatatatatataaaacctgccacctcagcctcccaagtagctgggactgcaggcatgtgccactatactggctaatttttttgtattttttggtagaggcagggttttgccatgttccccaggctggtcttgaactcctgggctcacgtgatctgagcgccttggccttccaaagtgctggcattacaggcatgagccactgcgcctggccaaaatgacataattagctttgatttggtctactgctcttaatcaaaaagctttttcatccttgtcccctggacacaagggcaatatgaagcctgacgtctgtttcttacagctcaacaccatttctggttgatgtgctgccactattcctagcacttctcagccatggtcttcaaagttgtatttcactctattttcaaaacatttcttctgtactctcattttct

SEQ ID NO: 2156 - DNA, 2377 bp, Homo sapiens
agccatcagacttggcctgagtggattataggcatgagccaccgcacccagccagctacctttttataaatcacactataaatgccaaaaattattctcaggaaaggcaagttatataacttgagcccccccaccccctcaaaaaaaaaactgctcagaaaagttttttttcattagtatttttatttataatttgctatctccattggtatcagagcaggaagttaagggagtagttacgaagcaaatttggaaaagcgatttggaggtggggagagaaagcttgtgaaaaaggcaaagggagactgttttgggcaggaggttgggtgggcaaagggtggaggacgtgaggaaggtgccaggaaaatgtttctatcaaaagatttaatttgaggtaaccttaatttgaatacatgctgtaaattaaaaacctcttttcttttcaacaggaaccacttgaattaaaattcccaaacatctcttatcctgccctggggctcctaaagggctgtctccacatggaccctactgaaaggctgacatgtgaacagctgttgcatcacccatattttgaaaacatcagagaaatagaggatttggcaaaagaacacaacaaaccaacaaggaagaccctaagaaagagccgaaagcaccactgctttacagaaacatccaagttgcagtacctaccccagctaactggcagcagcatccttccagctttggataataagaagtactactgtgataccaagaaacttaactaccgttttccaaacatttaaaggagctaggagacatgattttaaaaaaggaatcaatagatgctttgaagaaaataaaacttatacagttgattgaaaacaattacaatgttgaaaacacaccaggagaaaacataagcaagaaactgggaggccaactggcaagatatgaagggaaattccagatccagtcttccatgcttgatgatggtgtccagaaaagaaaaaacctgtttggagttgcacttgtatttcagtttatgtaagtagccgaacttatggacagaatatgaactgtcccatacctctggcaaaactagatgatatcaaaaagatttatgcttcagttgtaccacatgccacacaagaaaaatgaaccacaaaatgcccatatatatttcctcggatctctgttgcctgagtcctatctcctgcctctcagattgtttcagcatcatatttaagatagttctatttcttgaaatcaaaatgtttaaaatcccatttcctgcttgctctatttcttgatttttatattttaaaacattttgagggtaacacttaggttcaaaatatttaaaagcatatgaattatcacaaaagcttggtaatttataatttaattatatgtttccacatttcatccttactttatcagtaaaggatacaccttagtcacttttgcaggcaacgtggatttactgtaatctgtctacatttattcacccaattccccttgtaaacaatggcatgaagctcggcagctgattaaggcagtcaaagggtagagcaagacctacaggctttgcaggaactgaacctatcagcctgaaaataattagtatttcattctctctggcacagcctttgacctggtacatctataggcaaacctgtaattcagtgatctgggtttcagaagaaattacttgtgagcttttacttgagtcatgaaagacattatgttgtaaactgatgttttccctgaaacatctttttgcactatgtttgtatgtgtatgtatgtgtatgtatatatatatatatatatatatatatgctattctaacaactaatatattacactaagtagtccaaagtattgaggactcatagctttgcacagtgagacttaaaatgatgacacacacacacatatatatatatgtgttttttatatatatatataaaacctgccacctcagcctcccaagtagctgggactgcaggcatgtgccactatactggctaatttttttgtattttttggtagaggcagggttttgccatgttccccaggctggtcttgaactcctgggctcacgtgatctgagcgccttggccttccaaagtgctggcattacaggcatgagccactgcgcctggccaaaatgacataattagctttgatttggtctactgctcttaatcaaaaagctttttcatccttgtcccctggacacaagggcaatatgaagcctgacgtctgtttcttacagctcaacaccatttctggttgatgtgctgccactattcctagcacttctcagccatggtcttcaaagttgtatttcactctattttcaaaacatttcttctgtactctcattttct

SEQ ID NO: 2157 - DNA, 1328 bp, Homo sapiens
atttgaatttcagataaacaagcataacttttagtataagtacatcccaagtgcttcatgggatgtattatcctaaaaaaattatttgtttatctgaaattcaaatttaactgggtgtcctgtatttttctctgctaagaccggctaccctactttcattttcctttcactcttcttggctcttttgggccttttaggaatttgggatgattcaggctctgacaggcatggtactagatttattttaggctgctcttttgctgttgtccaacaggccaaggagagatttaaatgatttatccaatatttgctaaatagtcatgtgtttcatttatcccatatatagttcagccttaatattgtttttgttttgatttgttacactagtgcatacatagagacgtgaagccagaaaatatcctcatcacgaaacattccgtgattaagctttgtgactttggatttgctcggcttttgactggaccgagtgactactatacagactacgtggctaccaggtggtaccgctcccctgagctgctggtgggggacacgcagtacggccccccggtggatgtttgggcaattggctgtgtctttgctgagctgctgtcaggagtgcctctgtggccaggaaaatcggatgtggatcagctgtatctgattaggaagaccttgggggatctcattcctaggcaccagcaagtgtttagcacgaatcagtacttcagtggagtgaaaattccagaccctgaagatatggaaccacttgaattaaaattcccaaacatctcttatcctgccctggggctcctaaagggctgtctccacatggaccctactgaaaggctgacatgtgaacagctgttgcatcacccatattttgaaaacatcagagaaatagaggatttggcaaaagaacacaacaaaccaacaaggaagaccctaagaaagagccgaaagcaccactgctttacagaaacatccaaggttataatttgaaatgatctcctacctgccacctggtacagagagttggaatctagacttgaggatggcagttgtggctttcagctccagcatcctcattccagcactaggagacaggtcataggatctatcaaccagggccccagggacatctgtctcctgaagccccctctccctgaatcctaaaggtgcccttgtcctgctgcttcctgatgccacacaggggccagggtttctagcctgcatgagcacaggtctcaacaaggtacatgagtatgagtccagctaaggagactttttgggctttggaaaataaaatcagattttccccatgcagt

SEQ ID NO: 2158 - DNA, 2530 bp, Homo sapiens
ggctggtacgccccggaattagggatagagaacctgactacctccaggtctagagggagcagccccttcactatataaccaatttccctgactgcacatatggtaattccatctatggtgaataatgaatccattctaggccaaatagatactcttatgcagagcccagctgggacagtcacgtgcaaggagaaaagagaaagccagactgcagacatagctaatgcaaaggcacggagatacagactacacaaactagaagaaacgtagagtaagctgctttgtctcttgctaaatttctaattcctagcccttgggttttacaagttactcctgtaataatcaaatattttcattttctacttttcttaatttgagtggatttcaaataaccacagaccttaaaaaaaaaagacagccaagctcaaggccagatgggtaaaacctctaggtgaaagaaactataatgaaattcatataaagatatccaacagtcataaaaactgtatgtgggattttagggcaaggattttcaacagtcaacagtactggaagctgaggcttcagaacccaggtatggaaggcagggagtttgaactatgctccttgcacagaatgggaagccaggaaaatgcaaatgtcaaactatcctacagggaagtctctataaacctccacagaactcccacaaaagacacacttagggaaaaggtatgcagcccaaaatatacaagtctgttcaacttgctccctaaaataagggagaatgccgacaccgcaggaaaaaggagctaatggaactaacaagaactttaaagaaacaccaataaaccaagaacacgcgaaaatgacaaaataccaaataaaaatccaaaatagaaacaaatccaaaagaaaacaaaagttgatgaaataaaatctcagtaggaggattaagtaaaagaattagcaaattgaaagatttttaagagacgaagacagaataaaaagctccctatgtttaaaaggagtttttagaagaaaatagaaacaatgggggaagatggttaaaaattaataataactttccagacttgaagaaaaaaaactgaatcttcacattacagaagcacactatgtctagggcaggataaataacaaatctacactaggacacatcctgatctgcaacacactgaagataaagagagaacagtaaaaatatagattactacctgtaagattactacctacaaactaagagggctcagactaacagcagattttttcattagttaacactgaggcaaggagacaatagaacagtatcttcaaggcacagcagacagtactaaacaactcaactcggtcaaacctaactttctggccagcacttgtgaaatcaaaggctccccagtaatttgattagcattttcatcattttgtaatcttataaacaccttctccagtggggaagaaatagcccaaatgggaattttaggtacctaagacttcggctgccaactgtgcctaatatcctagtaatgttaacctttccagtacccagtatagaatacccctacaactgggcattttaaacaggcaaacaagtattacacacacttaattttgttcattccagccacatgaagtcaaaggatgtttctctataagaaactacaatagatctttgaaactttgcatgaagttgttttaggggccatacttcaagtgacaggaaataacaaatagcaatacacacacatttcattaagtggggatcttataaaatctctagaaccctgagaagttccttgctacttataaagccttttcttgacctgtcagacctaatgtttgatgatgtataagaaaactatcgtcgaatttatgttatgcataaattttatagtatatttaaagtgaaatacacaatttttttctatgcacatactcttactggaaaaaatttgaatgctgacaataaaatggctaagttatggtacatgcatgtaacagaatactatagagcagactgagcaaacttatgccacaggccaaatccagcccatggtaagtatttgtaaatagttttactggaacacaattatactcatttatttacatattatctattgatgctttcacactaccgtggtagtgctgagtagccatgacagagacctaatggtctgcaaaacctaaaatatttactaactaaccctttatagaaagaactttgctgaaccctggtatggagaaataaaaacgaatgaaatacagctgaatgagtcaacttcaatcaatctcaaaagcaatgctgagagaatcaaatcacaaaaaatacatgcagtataattcccattacaaaaaatccacaaatatgcaaaacaaacctgatactgttcacaaatgcacataaaaccatttttttttttaaggtaatgaagttgatcaacaccaagtgatctggggcagaggggtacgtagaagacatttaactgtgcagggtacattaacagtatatgtgctgatgatattctatatccga

SEQ ID NO: 2159 - DNA, 2815 bp, Homo sapiens
ccagtctcaagcttgcaaacaaaatgacagtggcctattaacttaggacagggaacttccaccataaactggtgcactaacatttaggctaagagccaaatcaagaacatcattctctcggtatctttatggagcaaaatgtttatggtagagacaggtgaccttgcagctagcctaaccacattctccaagtgttaattagatggtgcaatattcacatagacctagagtccactgactatggaaggctctgacctttttgcagcttctttaccaggagtgtataatcttcctagttcctaatctttctaagagaacctgactacctccaggtctagagggagcagccccttcactatataaccaatttccctgactgcacatatggtaattccatctatggtgaataatgaatccattctaggccaaatagatactcttatgcagagcccagctgggacagtcacgtgcaaggagaaaagagaaagccagactgcagacatagctaatgcaaaggcacggagatacagactacacaaactagaagaaacgtagagtaagctgctttgtctcttgctaaatttctaattcctagcccttgggttttacaagttactcctgtaataatcaaatattttcattttctacttttcttaatttgagtggatttcaaataaccacagaccttaaaaaaaaaagacagccaagctcaaggccagatgggtaaaacctctaggtgaaagaaactataatgaaattcatataaagatatccaacagtcataaaaactgtatgtgggattttagggcaaggattttcaacagtcaacagtactggaagctgaggcttcagaacccaggtatggaaggcagggagtttgaactatgctccttgcacagaatgggaagccaggaaaatgcaaatgtcaaactatcctacagggaagtctctataaacctccacagaactcccacaaaagacacacttagggaaaaggtatgcagcccaaaatatacaagtctgttcaacttgctccctaaaataagggagaatgccgacaccgcaggaaaaaggagctaatggaactaacaagaactttaaagaaacaccaataaaccaagaacacgcgaaaatgacaaaataccaaataaaaatccaaaatagaaacaaatccaaaagaaaacaaaagttgatgaaataaaatctcagtaggaggattaagtaaaagaattagcaaattgaaagatttttaagagacgaagacagaataaaaagctccctatgtttaaaaggagtttttagaagaaaatagaaacaatgggggaagatggttaaaaattaataataactttccagacttgaagaaaaaaaactgaatcttcacattacagaagcacactatgtctagggcaggataaataacaaatctacactaggacacatcctgatctgcaacacactgaagataaagagagaacagtaaaaatatagattactacctgtaagattactacctacaaactaagagggctcagactaacagcagattttttcattagttaacactgaggcaaggagacaatagaacagtatcttcaaggcacagcagacagtactaaacaactcaactcggtcaaacctaactttctggccagcacttgtgaaatcaaaggctccccagtaatttgattagcattttcatcattttgtaatcttataaacaccttctccagtggggaagaaatagcccaaatgggaattttaggtacctaagacttcggctgccaactgtgcctaatatcctagtaatgttaacctttccagtacccagtatagaatacccctacaactgggcattttaaacaggcaaacaagtattacacacacttaattttgttcattccagccacatgaagtcaaaggatgtttctctataagaaactacaatagatctttgaaactttgcatgaagttgttttaggggccatacttcaagtgacaggaaataacaaatagcaatacacacacatttcattaagtggggatcttataaaatctctagaaccctgagaagttccttgctacttataaagccttttcttgacctgtcagacctaatgtttgatgatgtataagaaaactatcgtcgaatttatgttatgcataaattttatagtatatttaaagtgaaatacacaatttttttctatgcacatactcttactggaaaaaatttgaatgctgacaataaaatggctaagttatggtacatgcatgtaacagaatactatagagcagactgagcaaacttatgccacaggccaaatccagcccatggtaagtatttgtaaatagttttactggaacacaattatactcatttatttacatattatctattgatgctttcacactaccgtggtagtgctgagtagccatgacagagacctaatggtctgcaaaacctaaaatatttactaactaaccctttatagaaagaactttgctgaaccctggtatggagaaataaaaacgaatgaaatacagctgaatgagtcaacttcaatcaatctcaaaagcaatgctgagagaatcaaatcacaaaaaatacatgcagtataattcccattacaaaaaatccacaaatatgcaaaacaaacctgatactgttcacaaatgcacataaaaccatttttttttttaaggtaatgaagttgatcaacaccaagtgatctggggcagaggggtacgtagaagacatttaactgtgcagggtacattaacagtatatgtgctgatgatattctatatccga

SEQ ID NO: 2160 - DNA, 3340 bp, Homo sapiens
aaaaaagccagaatggccaaagcaatcctaagcaaaaacaacctgacttcacagtacactacaaggctacagtagccaaaacagcatggtaatgatagagaacaacagacagataaaccaatggaacagaaaagagaacccagaaataaagccacatacctacaactatctcatcttcaactaaggtgacaaaaacaagcaacagggcaaggattccctattcaataaatggtgctgggacaattggctatccttttgtagaagaataaaaatggatccctatctttcatcatatacaaaaaattaactcggccaggcgcggtggctcacgcctgtaatcccactactcgggaggctgaggcaggagaattgcttgaatccgggaggtggaggttgtagtgagccgagatcacaccactgcattccagcctggcaaaagaatgagactccgtctcaaaaaaaaaaattaactcaagatagattaagaattcattactaagtcctcaaaagcaattgcaaaaacaaaaaatgacaagtgggccctaattaaacttaagaacaagagaaactatccacatttcaataaacatggtgtttttcactaacatttaggctaagagccaaatcaagaacatcattctctcggtatctttatggagcaaaatgtttatggtagagacaggtgaccttgcagctagcctaaccacattctccaagtgttaattagatggtgcaatattcacatagacctagagtccactgactatggaaggctctgacctttttgcagcttctttaccaggagtgtataatcttcctagttcctaatctttctaagagaacctgactacctccaggtctagagggagcagccccttcactatataaccaatttccctgactgcacatatggtaattccatctatggtgaataatgaatccattctaggccaaatagatactcttatgcagagcccagctgggacagtcacgtgcaaggagaaaagagaaagccagactgcagacatagctaatgcaaaggcacggagatacagactacacaaactagaagaaacgtagagtaagctgctttgtctcttgctaaatttctaattcctagcccttgggttttacaagttactcctgtaataatcaaatattttcattttctacttttcttaatttgagtggatttcaaataaccacagaccttaaaaaaaaaagacagccaagctcaaggccagatgggtaaaacctctaggtgaaagaaactataatgaaattcatataaagatatccaacagtcataaaaactgtatgtgggattttagggcaaggattttcaacagtcaacagtactggaagctgaggcttcagaacccaggtatggaaggcagggagtttgaactatgctccttgcacagaatgggaagccaggaaaatgcaaatgtcaaactatcctacagggaagtctctataaacctccacagaactcccacaaaagacacacttagggaaaaggtatgcagcccaaaatatacaagtctgttcaacttgctccctaaaataagggagaatgccgacaccgcaggaaaaaggagctaatggaactaacaagaactttaaagaaacaccaataaaccaagaacacgcgaaaatgacaaaataccaaataaaaatccaaaatagaaacaaatccaaaagaaaacaaaagttgatgaaataaaatctcagtaggaggattaagtaaaagaattagcaaattgaaagatttttaagagacgaagacagaataaaaagctccctatgtttaaaaggagtttttagaagaaaatagaaacaatgggggaagatggttaaaaattaataataactttccagacttgaagaaaaaaaactgaatcttcacattacagaagcacactatgtctagggcaggataaataacaaatctacactaggacacatcctgatctgcaacacactgaagataaagagagaacagtaaaaatatagattactacctgtaagattactacctacaaactaagagggctcagactaacagcagattttttcattagttaacactgaggcaaggagacaatagaacagtatcttcaaggcacagcagacagtactaaacaactcaactcggtcaaacctaactttctggccagcacttgtgaaatcaaaggctccccagtaatttgattagcattttcatcattttgtaatcttataaacaccttctccagtggggaagaaatagcccaaatgggaattttaggtacctaagacttcggctgccaactgtgcctaatatcctagtaatgttaacctttccagtacccagtatagaatacccctacaactgggcattttaaacaggcaaacaagtattacacacacttaattttgttcattccagccacatgaagtcaaaggatgtttctctataagaaactacaatagatctttgaaactttgcatgaagttgttttaggggccatacttcaagtgacaggaaataacaaatagcaatacacacacatttcattaagtggggatcttataaaatctctagaaccctgagaagttccttgctacttataaagccttttcttgacctgtcagacctaatgtttgatgatgtataagaaaactatcgtcgaatttatgttatgcataaattttatagtatatttaaagtgaaatacacaatttttttctatgcacatactcttactggaaaaaatttgaatgctgacaataaaatggctaagttatggtacatgcatgtaacagaatactatagagcagactgagcaaacttatgccacaggccaaatccagcccatggtaagtatttgtaaatagttttactggaacacaattatactcatttatttacatattatctattgatgctttcacactaccgtggtagtgctgagtagccatgacagagacctaatggtctgcaaaacctaaaatatttactaactaaccctttatagaaagaactttgctgaaccctggtatggagaaataaaaacgaatgaaatacagctgaatgagtcaacttcaatcaatctcaaaagcaatgctgagagaatcaaatcacaaaaaatacatgcagtataattcccattacaaaaaatccacaaatatgcaaaacaaacctgatactgttcacaaatgcacataaaaccatttttttttttaaggtaatgaagttgatcaacaccaagtgatctggggcagaggggtacgtagaagacatttaactgtgcagggtacattaacagtatatgtgctgatgatattctatatccga

SEQ ID NO: 2161 - DNA, 805 bp, Homo sapiens
cccattctgccagggaggacccaccagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagccagcttggaatt

SEQ ID NO: 2162 - DNA, 976 bp, Homo sapiens
cgtcagtccatctccaaagccgtgtggccctattaccagaaatatgtggatgaggcttccaagaaggagatcaaagacatcctcatccagtatgaccggaccctgctggtagctgaccctcgtcgctgcgagtccaaaaagtttggaggccctggtgcccgcgctcgctaccagaaatccctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagccagcttggaatt

SEQ ID NO: 2163 - DNA, 751 bp, Homo sapiens
cccattctgccagggaggacccaccagagatggctcccaatgcttcctgcctctgtgtgcatgtccgttccgaggaatgggatttaatgacctttgatgccaacccatatgacagcgtgaaacttttgctgggctccaagatcttaaagccacggagaagcctctcatcttatggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagccagcttggaatt

SEQ ID NO: 2164 - DNA, 597 bp, Homo sapiens
gcggccgccaactactactaaattcgcggccgcgtcgaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctggggatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaaggcaaaatagagcattcaaagccagcttggaatt

SEQ ID NO: 2165 - DNA, 529 bp, Homo sapiens
cacatttcataattagggtctttaatgattaaaatacatctaattataaccaaacatgtatagatttgattataaaatatccactttcttacaggatttgtgtgtatacatgtggagagaagtaaataggaatactatttactggtttatatttttttttttttttttttttcactaaactcaaccactcccccaacagagatgttgagtttagtggttggggtaactttacaaagtaaggtacattgatataattcatttaacaaatatgtattgattacccactttgcgcaaggtaatatgctaagtgctcgaggtagaagagtaaaagtaatagaaaatcttcatcttcattgaggtaaaatttcagcagatagtttaaaataatttgagtttaaattttatttcattgtatacctgtaaaacccaaaagaatccacaaaaaaattataaacagtaagagaattcaataaagtagctgcttacaaaacaggcaaaaataaatagacttccaatgagaaaatgtaag

SEQ ID NO: 2166 - DNA, 433 bp, Homo sapiens
gcaagttgttgactgggggcctgggctctggagacagacagcctggattgctggcctggcaagtggctgcccctctgagctccacgtgcacaatgcggataacataagtacctccctcccagggttggaggccagggctcagaggttaggcacagaggttactacgttgttggcaggggagtgggggcaggcagagcagctgacacctcctctgtgtttcctcagaccccacagcaatgggggcttcacaagaggtccatggacctgggaaccaattcctttccctccttgcccttcagtctcttctctggtaatcccagcaacttgggaggctgaggtgggagaattgcttgaacccgggaggtggaggttgcagtgagccgacatcgcgccactgcactccagcctggacgacagagcaagactctgtctc

SEQ ID NO: 2167 - DNA, 401 bp, Homo sapiens
gcttagacattggagcagttcttaggatgcttgctgcagccaacagacaaaaggaaaagtgacttctctacactttatgatttacatcaattttatgtaattaaagtaatttagagctgagtttctgagcttataattagggttttaaagcttatgtaaagctgctctttcaaggagaattacttcttagatataagagcagatttggacagaagcatttggattctgtcaaaagacattattttgtgtgtatctgcctactgtgaataccgacataacttccacactaaattatgactatggcttcttgaaatgtcaccaaaaacaatgtgataaaaacgcaagaatatgtcctgtttagtgataacctctatagtgaatttcattgggtaaaattaaaa

SEQ ID NO: 2168 - DNA, 414 bp, Homo sapiens
tccaattgtaacaaaatagaattggactaaatcaccaaagtttctcccggcccaaatactatgactggagaggggtgggagaggtgatatttttatgttctaattctcaatttgcttgtggggcagaagtatcccatagctgagtataatgtcataaaataggatatgtgtataaacaatggaatagttagttctggcctcttctggaggtggcttcacaccacactaccattttcttctcctaacacaagttcactggcaggtgagcattttgggaagtagagaagttttttggtttggggcttaatttgggtctttaaaaatgtcttttagatcaaattttagattctacatatgtgtaagatcaggcagttattagtcttttctttccctgacttatttcacttaatcctc

SEQ ID NO: 2169 - DNA, 366 bp, Homo sapiens
aacccaggaggtctaggttgcagtgagccgagattgcaccactgcactccatccagcctgggccacagagcgagactgtgtctcagcctcccaagtagctgggactacaggcacatgccaccacacctggctaatttttgtatttttagtagagatggggtttccccgtgttggttaggcttgcctcgaactcctgacctcaggtgatccacctgccttggcctcccaaagagctgggattacaggcatgagccacagcacccagcccaaagttactaaaattaaatgagtccattatgaataattcaaatataatcaaatgaactggttaatgaaaactcaattttgacttctgtacttctgaca

SEQ ID NO: 2170 - DNA, 438 bp, Homo sapiens
atatattcttctctaaacacaataacattttatttatttttatttatttatttaatttatttttgaagatggagtcttgttttgtcacccaggctggagtgcagtggcatgatctcggctcactgcaacctctgcctcccgggttcaagctattcttctgcctcagcctcctgagtagctgggactacaggtgtgcaccaccacgcccagctaatttttgtatttttagtagagatggggttgcaccctgttggcccaggatgctctcaatctcttgacctcgtgatctacccacctcaccctcccaaagtgctgggattacaggcaggagccaccactcccggatacaacactattattatatataacaaacttaagtttaagtttaacatgtaatactgaatttatatttaagttttccagattggcaaaaaaaaa

SEQ ID NO: 2171 - DNA, 504 bp, Homo sapiens
ggaggatgtaaagttttaattcacttttccaaactttctcattcaactaacttttttcatatcactttacaaagttccagatgatttccaggctgccgattttaatattaagctctatttgagcagggtcccagagggataattagcaatacaagaaaatattttttattctacccaagtaaatatctttattatctaaaaatgacaatagatgatggaaaacacacgggggagaaaaccttgattccaaattctaaattatgatctgtcggaaatgatgctagtacttgcaataatgtagtgaagtccaagaatctcttgtattaccaacagatgcatccacaagaaacacttctgagggtggcctcttgccttgtggccagaattgcaatttgcatagtttgccattgtttgtaacttcgcttcactgactcctagtgaacttgaagctttggcacaaaatgaccctagcccttgaatttatattcactcaccttgtttctt

SEQ ID NO: 2172 - DNA, 381 bp, Homo sapiens
caagatccgaggagtgaggggcaggaaaaagagtgaggccctgagacaggttgacctgccttctaattctgactctgctctttatagctgtgtgcctctgggcaagttgcttaacctctctgatttccagttttattttaaagttgaagaggtgctaatctatctggtgaggttgtgggaaaaattaatgaaacacatgaaagtcccttaaacttgctaggacttactaaatgccagttctgtctccttcctaacaccttcccccaacccccaatctcttcacgctcactcttgtacatttccaccctgctggaaaacaaagatgagaacaaaatgtgcattgctgagacttactgttagactgttttttaaggtgtcctt

SEQ ID NO: 2173 - DNA, 383 bp, Homo sapiens
catactattttgacacccagggtatttcttttccatcgatctgcctaatttctagtgctttttgtttgtttgttttgttttgagacagagtctcgtactgtcaccctggctagagtgcagtggcgcgatctcggctcactgcaacctccgcctcccaggttcaagtgattctcctgcctcagcctcccgagtagctgagattacaggcacctgccaccatgcccagctaattgttttttggtgtctatatttttaatagacagggtttcactgtgttggtcaggctggtctcaaactcctgacctcatgatctgcccgcctccgcctcccaaagtgctgggattacaggcgtgagccaccgtgcccagccacttctagtgttt

SEQ ID NO: 2174 - DNA, 295 bp, Homo sapiens
ctacgtaaaccagcttttcctgacggtgtgcccagggcccatttttcaagtcacaccaatcaattctcaatgagctgcctttgggagggacatgcccagcaaccctggatgagactctccagccttggaggccccagccctgcccgaaggactcttgggtgttccctccttctgcctggttagagagccccttaccctactctgtccttgcccgccttgcgcgggtggaggtggccctcggaacccagggtgcggaacccacagtgcggatccactttggcccagcgccacaccc

SEQ ID NO: 2175 - DNA, 398 bp, Homo sapiens
ctcaatgcattttatttccattagaaatcattttgggtaaagtatctctaagtttaaaacagtgagtacaattgtcaatataccatagagtgtcccaaaaaatctggaaacatgaagggaactacaaacttatattacttttttttccgatcaacgattgttcagaccttgagtacattcaatgtctttccttgttcagtgaaagaaaaattgtgtgagtgatcatactttttgtctcagaaggaaaattataccatccaaatttaaaatttggccagatgcagtggctcatgcctgtaatcccagcattttgggaggctgaggcatgctgatcacttgagcacaggagtttgagaccagccttggcaacatggcaaaacctcatctctacaaaaaaa

SEQ ID NO: 2176 - DNA, 920 bp, Homo sapiens
taacggcatctgtccatcccgggaagctggagcggggagggacagagggaaatgcaggcctcatcctcactctgccctgcagtgtggcctgggaactcctgaagaagccagcatgacaagggagcaaaaccaatgtcaccaaaccctcactacacaccacttgctgggataactcttcttcacacttgatctctttcaatccccagattctcatgagataggaattatttttgcccatcttacagatgagaaacctcaaaaagtttaaagcgattgcttgcgatcatccaatttatgtgtggcagggccaggattcaaaactacatccatctgatttcgaagcccattgcctctctttataaaagaatttctcctctgtctccctgctccccgtgagacacagctcatttgttttcctataatgagggaggggccttcgatttcctaatagattgctcacctgccgtcctagtggagctggcatttactgtggcatttactgtgtagctgcagagccttccccaccagacacatttgtactttgtgacagcaagaacacatggacagctgctggggcatttctaacacagcccttctcaggcagagatcttggctggggacagcatgactccatcctccaggagaggacaagccatgcggcatctctaattagaacccaggctggaacattcagcttaatgagctgggagttggaaacgctcagctggaaacgagttggtctggcagaaaggacataggactgagggacacattttctaaactctgtcctcatctcagttgttaatcatcttctgcttctgtctatccatcagttggttattagactgtgttattgtgcatttgcctcaagttcagagtgaacatgcgttaaatatattggacgatggcttaaatggatg

SEQ ID NO: 2177 - DNA, 344 bp, Homo sapiens
caaggctattgcagtattctagccaaataattatggcggcttggaacaagatgacagtggtggaggtggtaagagttcatgggactctggatgtattttgaggccagggctgatggaattgaaagaggaatgtgaaagaaagaaaagtctagaatgactcctatctttatgcccatgcaaatggccatttactgagatggagaatgctggaagaatagtatgctgggagggtgatatctcacccacccttatgggatatgccatatcatgggagggtgagataccctgccatatcatgggagggtgagatatcaagaacccaattttaggctgggcacagtggt

SEQ ID NO: 2178 - DNA, 373 bp, Homo sapiens
gtggtatacaagaagtggtgagaagggtttagattctagaaatatttttaaaataatatcaacagatattgttgatacttcaatgtggggtatgagagaaagagaggattcaaggatgatgccaagatttttggcttgaactattggaagggtggagttagtggctgggcacggtgcccacacctggtaatctcagcactttgggagaccaaggtgggagaaacacttgtagccagaagtttgagaccagcctgggcaacatggcaaaaccctgtctctacaaaaaatacaaaaattagctgagcgtggtgtaatgtgcctatagtcccaggtacttgggaggctgaggtgggaggatcgcttgagcccaaga

SEQ ID NO: 2179 - DNA, 342 bp, Homo sapiens
gagtggcagcagggactgctgaggaagctgccgggctccctgtgtaccactggccttcatgaacaaagctgacaccatcatgctccttcggacatattctgctagcataaagggacccccatctccccaaccgaattaggcagagctggccttccttctagcggagttcctaggagtgagttggtgccaccccttgtgaggcttgatccaaaaaccagaacctctccagaccagggatccatgtcctctaacacaagaggggcagacctaacctctaaaatccctcccactctaaccttcagcatccacagctcaaaacaaccaggatgcctcagaaacagc

SEQ ID NO: 2180 - DNA, 393 bp, Homo sapiens
ggttagcctggtcttttctctgtgatctctctcatgagttctttactccagtctttattctgctttaaggagagttttgggcattcttagttaagtgtggtgtttggctgatgttgaaataactcattcattatgagcctccccatccccattaaatgccttaatttcataggagacaaaaaatttaagaaataatgccattgtatacctcctaccccattgcatatattaagtaaaaggaaatgagtcttgagaacattgagaatgaaaacgtttgagtaggccaggtgcggtggctcatgtctgtaatcccatcatgttgggaggcccaggtgggaggattgcttcagcccaggagttccagaccagcctgggcaacatagtgagacctcg

SEQ ID NO: 2181 - DNA, 351 bp, Homo sapiens
cagttgggaatagggcgtggcaacaggactttgaattgcctgagattaccctgaatcagcataacaggacacacaccggggtggaccactagtcaaaacggggcttgaaaaggaatgtaaatgttactatagaaaatcaaagaaagttacgtttttgctgcaactgagtatgtactctaagattcgtacttgctacaattatataaaatgttttccatgtctgagaactcattattattttagttgacaatatctccatcaagtgacaacactgtattttatttagtcattctcctattgttgaaaattaagattgtttcaattgttaagtataatataaatactacaaca

SEQ ID NO: 2182 - DNA, 445 bp, Homo sapiens
  misc_feature (289)..(289): n is a, c, g, or t
gtgctcttctccctgaccctcctttcatattcatcctaaatgacaagacctttccttaaaaacaagcatcttctcctcccatggcaagacaaggctgccctttgtgtgttgttttcattaatttgttgatacttgttttcaagctacattttattggacttgtgcttactttgctgaagcacaaaggttgtttaagcagaagggcacaagaaagtggaaaactcctgacctcaagtgatccacccacctcggcctcccaaagtgctgagattacaggcgtgagccaccnacacccgatcacgggtcttcctgcttctgtgatcaccttctcataaccttgagaccactgcacattgatgaagttcagttaatctacaatgactgtagccatctgagtgaccccaggtgagaccaatagaactgtcgaactagccaacgcacagca

SEQ ID NO: 2183 - DNA, 1055 bp, Homo sapiens
gtttctgattagaattttaaaaaagaatgtaagagtgaataaagcatttgggtcccatactgcatagtaaacagtaagaatgtacgtattttagggggttcatgagagagaaaattttaaaaattgtttaaagatataatgtcttaaatttctaccaatcttggaagaaatatagacattaaattgaaaagctcaaaatgtctgtagcaagaagaatctaacaaaaattgtccataacacgttgtaattatgccaaaattcaaagacaaggagagatccttaaaagaaggaagagaaaagagattcttcacatacaagggaacttctataaggttatcagcagattgcccagcaaaaaccatgcaagccacatggaagtgaaaccgtatatttaaagtgcaaatgaagagagaaaaagaaaaaaccttgacaactaagaatacacctgacaaagctgttctttagaaatgatgtatcaatcaaaatctcagatttaaaaaaagttgaggaaatttttcatcactagacctgacttacaaaaaatgctaatgagaatttttcgagttgtaatggaatcctaacttacaacaataaagtaaatattactgaaagtcatatatacatagtcaaatttagaaggctataaacctgtaattatggtcaaaaatcacttttaactatggtataaaaactataagaaaaaattactaaaaatagcttcaataaattgttaatgggtatacgatataaaaagatgtagcgtgtgaggctgggcgcagtggctcacgcctgtaatctgagcactttgggaggccgaggtgggtggatcatgaggtcaggagatcgagaccatcctggctaacacagtgacccccgtctctactaaaaatacaaaaaattagctggttacagtggcaggcgcctgtagtcccagctagtaggaaggctgaggcaggagaatgccatgaacctgggagcagagctagcagtgagccgagatttcgccactgcactccagcctgggtgacagagcaagactccatctcaaaaaaaaa

SEQ ID NO: 2184 - DNA, 1278 bp, Homo sapiens
gcgggagccctaggccgcagccgccgcctgtcggcccggcccgggtcccagctgcttcggtgtctgggtgaagtttccagccaacccaagaaggaaaccgaaagggaagaggccgagagagaggttaattcctagtgctttggttaccgaaaacagcccggctgggactgctgggctgggaacttagctaagcagtgcggaggctgaaccccaccatctctgggatccgcagcaaatcagaagcccccacccacgataaggggaaaatggggcgcagagggcagggaggaagggaagagaatggaaggaaagcgcgtctggactttgaactgcagccctctccctctttcccttgcctcggaagctccaggcccactcagcaccagttctgtctcctcttttcagccgccttctctctagctactgaggggaaaagtcaggatgaagcgggtccctcggcctccagaaggtgttttattacagtcgcaaacaggtagagcggcagccaccccagtgatgactccctgctccttagattgtagggacgctggcacctcactcatgctcctaagtggccattttgcgccctggctgggcgagttaggcagacaaaatgagcccccaaaagtttaaaggcctccaccaaaggagtatttcttttctgaggtgtcattgtattccatccacgaacttcagttcccccgggtgctctggatctgacatggagtaggatgctaacatctaatcccttctttccctttggaaagatgcatgttttttctcggagtcctagggaataccttagaatactttcatggttgtcattggtacacccatcccttgaggagccctgccacccgtaagtaggactgcaaggaaatacaaaattaagagaagtatgaaccctgatacccaggaacttaaaatcaggtgtataaattttgtacacctaaaaaatatggtacctaaagaggcgaacagcaaaacaagcaagaatgtgaatctttaaaatgtttctattcttcagcgcagcccaggaattctacctaaagtaacatatcctaaggcaacaaccaagaagtgtggaagaatgcatgtaagaagacacagtgatgtttagaatcctggggaaacggaacagccaaaaagtctcacagaggttaagtaaataatagcattttcatacgagtactatgtagtcatttaaaattatgtctttcagtacctagtaatggggaaaatgtattcattatatattattaaagaaaatacagggta

SEQ ID NO: 2185 - DNA, 401 bp, Homo sapiens
tggctaagatcaagtgaagaaacaatctacagtctgttttctgatacaaaactgagactcttgaggatgatcatccgaaaagcagtttcatggtctttttcctaagtgcacactgccttaggcagattccccataccataactcagcagacatttttcagttcattctcatggctttgtgagctctcctgttatcaatcgaattcatttacttagttcagtagaaagaacaagggccacagactcagacctgctttgaatcctgggctctaacagtgacttgctttgtgatcttaggataagtaattagtacaaagcctcactttttccactggtccatgggggataatatcattggcttttcactgggattgagaacattaaaagagaggtgggagtagt

SEQ ID NO: 2186 - DNA, 434 bp, Homo sapiens
ttatagaaactatagtttatagaaactatagaaacagaactataggtcacaaaagacaattctaataaatagaagatgcaacctgggtaatctatgagtttaattcacctttagggcacattatattgtagagctatggatgcaagatgaagaagacgtggtttctatctgtaagatgcccaaggttgtatggttgggacagggcctctaggactattaagtcaaaccaggctgagcacagtaacttatgcctgtgatcccagcactttgggaggccaaggcaggaggatcacttgagcccaggagttccaagactggactgggcaagaaagtgagacacccgtccctaccaaaaagaaaacattagccaggtatggtcgcacatgccgatagtcccagctacttgggactgagggaggaggatcccttgagcc

SEQ ID NO: 2187 - DNA, 413 bp, Homo sapiens
gactaagttttaatacaatttagtattatctcaaaggaatgtaaaaatattttggtcaattattacattatgcagtattactaaaacatctaagttttgtcatatctccccattgaattcttcttttaaagtttgctggccgggcgcggtggctcacgcctgcaatcccagcactttgggaggccgacgcgggcagatcacaaggtcagtagatcgagaccatcctggctaacacggtgaaaccgcgtctctactaagaatacaaaaaaaaaaaaaattagtccggcctgtggtggtgggaggcttgtagtcccagctactccggaggctgaggcaggagaatggcgtgaaccagggaggcggagctttcagtgagccgagatcgcaccactgcactccagcctgggtgacag

SEQ ID NO: 2188 - DNA, 401 bp, Homo sapiens
ctcacggggtctgtagtgaacctcgtcttcatcctcatcctctccaagatctatgtatccctggcccacgtcctgacacgatggggtgagtgggctgaggccggccaggcactgaccaggggcccaccctgccggccgccagccagaacgtgactttctcactcactgacacacatggccctcatttctatttctttcttcttttttcttttgagacaggatctcactctgttgcccaagctggagtgcactggcacgatcatggctcactgtagccttgacctcccaggctcaagggatcctcctgcctcagcctcctcagtacctggaccactgtgcccagctgaaattttttttttttttgatagagacaggggtctcactgtgtggctcaggctggt

SEQ ID NO: 2189 - DNA, 482 bp, Homo sapiens
agcaaagagattcacagtgtgagcgagattcaacgtgaggggcttcctccgctgtgagctttgaaaatgaaggggccatgtggcaaaggatatggcgggctccaggaattgagagcagctccaccccacctccacctgacagctgcccaggaacaaggactacaatctcacaactgcctgaaactgaattctgccaccaagctctgtataagcttgaaggaggaccccagcctcaagatgaggacacagcttcgtgaaatcctgaactgagaatcattcacaccaggcctggatttctcattaaggaaatgtagagaaataaatgggtgctgtgtagagccagtgagttagtggtaatatgttatgcagtaacagaaaattcatacataggccaacagataagcatataacattttctctattggaataaactagtgaattgaaatgtacactccttgtataagataaaatctttcctaatt

SEQ ID NO: 2190 - DNA, 1933 bp, Homo sapiens
aggggaggctcaggccttggattttaatgtcagggatggaaaaacttcagaatgcttcctggatctaccagcagaaactagaagatccattccagaaacacctgaacagcaccgaggagtatctggccttcctctgcggacctcggcgcagccacttcttcctccccgtgtctgtggtgtatgtgccaatttttgtggtgggggtcattggcaatgtcctggtgtgcctggtgattctgcagcaccaggctatgaagacgcccaccaactactacctcttcagcctggcggtctctgacctcctggtcctgctccttggaatgcccctggaggtctatgagatgtggcgcaactaccctttcttgttcgggcccgtgggctgctacttcaagacggccctctttgagaccgtgtgcttcgcctccatcctcagcatcaccaccgtcagcgtggagcgctacgtggccatcctacacccgttccgcgccaaactgcagagcacccggcgccgggccctcaggatcctcggcatcgtctggggcttctccgtgctcttctccctgcccaacaccagcatccatggcatcaagttccactacttccccaatgggtccctggtcccaggttcggccacctgtacggtcatcaagcccatgtggatctacaatttcatcatccaggtcacctccttcctattctacctcctccccatgactgtcatcagtgtcctctactacctcatggcactcagactaaagaaagacaaatctcttgaggcagatgaagggaatgcaaatattcaaagaccctgcagaaaatcagtcaacaagatgctgtttgtcttggtcttagtgtttgctatctgttgggccccgttccacattgaccgactcttcttcagctttgtggaggagtggagtgaatccctggctgctgtgttcaacctcgtccatgtggtgtcaggtgtcttcttctacctgagctcagctgtcaaccccattatctataacctactgtctcgccgcttccaggcagcattccagaatgtgatctcttctttccacaaacagtggcactcccagcatgacccacagttgccacctgcccagcggaacatcttcctgacagaatgccactttgtggagctgaccgaagatataggtccccaattcccatgtcagtcatccatgcacaactctcacctcccaacagccctctctagtgaacagatgtcaagaacaaactatcaaagcttccactttaacaaaacctgaattctttcagagctgactctcctctatgcctcaaaacttcagagaggaacatcccataatgtatgccttctcatatgatattagagaggtagaatggctcttacaactcatgtacccattgctagtttttttttttttaataaacgtgaaaactgagagttagatctggtttcaaaacccaagactgcctgatttttagttatctttccactatcctaactgcctcatgccccttcactagttcatgccaagaacgtgactggaaaggcatggcacctataccttgattaatttccattaatggaaatggttcgtcctgagtcatctacgttccgagtcaggctgtcactcctactaccaatggccactgtgagccacagaaggaagacatgtacgtgctgttctactttatatgatgtgagaagccaacatcagtgtcccttggcagcagtctacaggcataacttgttttattgtgctgaattttattgtgcttctcaaatattgcacttttaaaaaaattgaaagtttgtggcaatgctgttgagcaaatctgctggcatctttcttcccaaaggcatgtgctcacttcatgtctctgtatcaattgtcataattttcgcaataaacttgattattattatatgtgcttatggtga

SEQ ID NO: 2191 - DNA, 1454 bp, Homo sapiens
cattggtgcatatatcaataattaatttccttttattgctgagtagtatttactatatggatgtaccacattttgtttatcctttcaactgttgctggacatttgggttgtttccagttttgagctatataaacaaagacacaaagatttgtatgtaaagcatcgtatggacagccaccttatttctcttggagcagaaagggaccttaaagatgacagaccaaacatcaacttcacagatgatgacacagaaggtgaatctactgaaaagagctaaagaaagacaaatctcttgaggcagatgaagggaatgcaaatattcaaagaccctgcagaaaatcagtcaacaagatgctgtttgtcttggtcttagtgtttgctatctgttgggccccgttccacattgaccgactcttcttcagctttgtggaggagtggagtgaatccctggctgctgtgttcaacctcgtccatgtggtgtcaggtgtcttcttctacctgagctcagctgtcaaccccattatctataacctactgtctcgccgcttccaggcagcattccagaatgtgatctcttctttccacaaacagtggcactcccagcatgacccacagttgccacctgcccagcggaacatcttcctgacagaatgccactttgtggagctgaccgaagatataggtccccaattcccatgtcagtcatccatgcacaactctcacctcccaacagccctctctagtgaacagatgtcaagaacaaactatcaaagcttccactttaacaaaacctgaattctttcagagctgactctcctctatgcctcaaaacttcagagaggaacatcccataatgtatgccttctcatatgatattagagaggtagaatggctcttacaactcatgtacccattgctagtttttttttttttaataaacgtgaaaactgagagttagatctggtttcaaaacccaagactgcctgatttttagttatctttccactatcctaactgcctcatgccccttcactagttcatgccaagaacgtgactggaaaggcatggcacctataccttgattaatttccattaatggaaatggttcgtcctgagtcatctacgttccgagtcaggctgtcactcctactaccaatggccactgtgagccacagaaggaagacatgtacgtgctgttctactttatatgatgtgagaagccaacatcagtgtcccttggcagcagtctacaggcataacttgttttattgtgctgaattttattgtgcttctcaaatattgcacttttaaaaaaattgaaagtttgtggcaatgctgttgagcaaatctgctggcatctttcttcccaaaggcatgtgctcacttcatgtctctgtatcaattgtcataattttcgcaataaacttgattattattatatgtgcttatggtga

SEQ ID NO: 2192 - DNA, 533 bp, Homo sapiens
atttttctcagcgtcgacagatgaatggctcaacaaaagtgtatctcttaatttagaaatcttatcttaggcctctgtaatcaatcaactgccgtgcacagttccctaaatgtttctttttcttgcctgagtagatatttaaatttccttttagaaatcactagggtaaaaagctagcaagtatcttagcaatttcaggaggttacatgaataacattttaatattttgaaaatgtagaataaagacaggatagttaaccagaaagttactttttgtggtgtaaaacttggaactttgaaattggaaatggaaaatagctttaaagccagcattcctatttttcttgcccctaggagaaaagagctcagccttattttaaattaattctgtgatactatttcccattagaaattttaagtttgacttattctaaaactttctctcagctctagtggtcatattttcttaatcatgatgggaaaaatatatttccataaggtgctttaatgtttgagctgaggtcttaaactga

SEQ ID NO: 2193 - DNA, 552 bp, Homo sapiens
tgaagaaggaagccaggtaaaaatgtgattgaatttcattctaaggaaaatgaggggctgttaaagaatgatattaatgtaattagatttgagttattgaaaacttcctctacctgcatttggaggctcttcacggacaacacatgcctacttcactgactataaattgaagctaattaacttagaattatcggagcttaacccgaaatctgagatagtaaagaaaaaaaagaatgtctgtatgtgtaggcagaagatcaaaaaagcaattctgaaaagaatttgattacaggctgttcaagatattgatcaatatttggatgaagactctttcatctggtgaatacccaggtgagcctaaacttacacaagaggatttactggtttatgtaagtgaaaattccaaaggtactcccttaggtatagcagagtccagaggctcaaatgatgccattgctgctctcctctgcattgacttcatcatcggttggggtggactcttcccttgtggagctaagatgtcagcaacagctgtgggctgttaccctcctg

SEQ ID NO: 2194 - DNA, 337 bp, Homo sapiens
atagggtgggttaggggctaattaacattccccagcccagagccttccccttaattttttttacatcttgatagaatgatttcaatttgttctgtaaatcacactggactcccctgtaatgattacagaaagaaaaatgttttttatatggatatatgggtataccccaatttgaaggcataaaggcacaatagcggactctaaagtaggaatgaggaaagctggaaaggagggggctatgctgatatagaccatcaagaaaagcttgaagagatgtcccaaataccctgatgacttacttttcactgaaatgcaaagaaattggcatcttagatat

SEQ ID NO: 2195 - DNA, 429 bp, Homo sapiens
atcactttgagcatctgataaaatctgtagccactcttctcagaaaaaaaaaaagtagtcccatgggggctggcgggaaggtatggatctcctaagtcctccgtgaccagctaagaatgccttttctgcaagtgggatggggctgctttggagcctgcagatgtccctgcatggacttcacaaagtgattgtattctctggtgaaaactaaaacagcaggtcttctgagtattagtgagacagggtcatgtaaatgaaaatcgcaacctttagagtgaggcagactttggtttgaatccaagttctgattagagtaatcaacttgtaccattttgagagggactgttccagtttgaaaactggcacatgtatacatatgtaacaaaccggcacgttgtgcacatgtaccctagaacttaaagtataatt

SEQ ID NO: 2196 - DNA, 442 bp, Homo sapiens
cgacttcttctcaaacaaaaattaccttgccttcttctaaatttttaggacatttgtctgtgctaatcatagtttattcccatgcattataataatttctagaaagcagtgtaatgttgtgtttaaaagcttgggctgcagagtcaagcagggttcaagaccttccatcacttgctgtgtgacctggagcaaattgcttaatcagtatgcatttttttctctgttgtaaaatgaaggtgataatagctggacctatctaataagctgttatggagatgaaaagagataatggatgtacagctgctggaaatcagtaaaatctcaggaaatgtttcctattatttttactgagtactatctactctagcagataataggttcctgaagaacatggaacatgactcagagaagttacagtgaataaactcattacagacatctc

SEQ ID NO: 2197 - DNA, 410 bp, Homo sapiens
agtcttatttgttattttgaaacattttctggagatgtgtctaaggaacatacactgacaccagcaggtttattgaaaaggatatggatatttgaactgaaagctgagtgttgatgaaaaatatccagaataagtggaattctaaaatatgtggattttttcttttgctcttgaggatggtttaaattttagggaataaagtgaaaagcaagagaaatagcaaaacgtgatgaaatggaactcaaaacatttatattttaattttcatggtgccctgtatttatgaatctttttccccaagccatctgcttgcttttaagtcatttctaggccctttttccctccaaaatgcattactgagggctcttttttgagttggaatggagagggggtttgtgagaagactgggt

SEQ ID NO: 2198 - DNA, 533 bp, Homo sapiens
ctgggcgacagaccaagactccatcaaaaaaaaaaaaaaaaaaactttccccaggtaccatggctcatgcctgtaatcccagcactttgggaagccaaggcaggaggatctctcaagcccaggaattcaagaccatcctggacacgcagctcaggctctgtggactaggatgttaaacccaggcctgtctgactccagcacgctctcaagctctgctctcctgcaaggctggcacagaggggcagggatcttggctctgtctgagggcgcagccaggtgggtgtctgggaaggcgggctgagggcagggtcagagctcttcagattgcctgcttttcgttacatgcccttctgtcttgggtttatggccatgggctggggaactcatggctgttggctcagagcagcaatcaacagagtgaactctaacaagctgggttctgaaacgtcagggtgggagcagccggccagggaggaatggggtaaagagcacggaggagaggaggagggaggaagctgatgagggttcaacca

SEQ ID NO: 2199 - DNA, 1375 bp, Homo sapiens
gtagggttattcttggactaacatctttaagcagttttcacttgcagtggaaatgatgttcaggctttaagagaaagtattgtgaattgttaatggcactaacttctgttactagacagcagaccaagctatttttttgttgtagtctttttttcactaaaccaaaactacttctggttgtaactcagctgccactttaaaccatagtagagattcaaaacgttcctatttgaaactacatttgatttttgctaaaatgtgctgtttcggttatttatctcttgggcatttagactaaattgtgcctgtattcctgaaatcaataatactttggcttatcctgatctaagtaacatagttacttaaattcctggatatacccaaatatggatcacatgtatcattttagtttgaaattttttgttgacattcttctatgaagagctgacctcttgaaatgtagaagaattgacatttgtgtgattttggctatctggagctttatttataatttattttgaaaaataaaaatgccacatttatttcccaaatgtcaagattttctagaattagataattagaataataaggctgaagacattttaaagcatattttatatgtagtgaaatactgtgaaaatattagtgaacagcattttgctgtaatgtttatttcagttattaagatttaaagagttagtcatcagggtatgttagataaacatagttatcatttattaaacaaacagataattttctgtttgcatgcaaattattttaataagtgtgaaaataaaagtttggaagatagtatttttacttttatatctggacttttttttcccccaatttacactttgctttcttgtaataccacctcctgtgaatgtgttgtaattagtatcacattgattactttatcattttaatttctttgaggccctttaaacctacgtaaaatctgggtccagccatagcaaagcaagtacaaaatgaacaaagaattttgaagaaaagcctaaatcttaaattgctaagaaaaaacactgttatatttaggcccgtgagagcatatacatgtataaacctaatcctatgctagatatgaatagtcagtgagctgtaatatttctcataaatgctaataatgtttaaattcccagctttaagatcttagtgtgtgtatatatttataaaatctgaattgtgtgtttcttctatggcttactgtgtgtttctctttcagcaataggatgctctctaaaacattcactagcctactagcctacttactaaatttttgtatatgtgtgtttgtgcacttgtatgtgtgtaaagttttttccccaacttgacacaccttatctcagacatt

SEQ ID NO: 2200 - DNA, 629 bp, Homo sapiens
ccagcaacgcggcacgaggcggcacgagggtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagttttttttgtattgattttcacagctttgaggaacatgcataagaaatgtagctgaagtagagggggcgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaa

SEQ ID NO: 2201 - DNA, 3391 bp, Homo sapiens
catttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccaccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtggaatgagcagcccttacagtgttgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctccccaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagttttttttgtattgattttcacagctttgaggaacatgcataagaaatgtagctgaagtagagggggcgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaagttaaaaaaaaaaaaggagg

SEQ ID NO: 2202 - DNA, 3337 bp, Homo sapiens
catttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccaccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtggaatgagcagcccttacagtgttgttaccaccaagggcaggtaggtattagtgtttgaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctccccaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagttttttttgtattgattttcacagctttgaggaacatgcataagaaatgtagctgaagtagagggggcgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaagttaaaaaaaaaaaaggagg

SEQ ID NO: 2203 - DNA, 2472 bp, Homo sapiens
aatcgagctggaccggaaaggtagctgtactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtggaatgagcagcccttacagtgttgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctccccaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagttttttttgtattgattttcacagctttgaggaacatgcataagaaatgtagctgaagtagagggggcgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaagttaaaaaaaaaaaaggagg

SEQ ID NO: 2204 - DNA, 3371 bp, Homo sapiens
catttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccaccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtggaatgagcagcccttacagtgttgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccccacttccccacaggtgaaagtttttctgaaagtgttgggattggttaaggtctttatttgtattacgtatctccccaagtcctctgtggccagctgcatctgtctgaatggtgcgtgaaggctctcagaccttacacaccattttgtaagttatgttttacatgccccgtttttgagactgatctcgatgcaggtggatctccttgagatcctgatagcctgttacaggaatgaagtaaaggtcagttttttttgtattgattttcacagctttgaggaacatgcataagaaatgtagctgaagtagagggggcgtgagagaagggccaggccggcaggccaaccctcctccaatggaaattcccgtgttgcttcaaactgagacagatgggacttaacaggcaatggggtccacttccccctcttcagcatcccccgtaccccactttctgctgaaagaactgccagcaggtaggaccccagaggcccccaaatgaaagcttgaatttcccctactggctctgcgttttgctgagatctgtaggaaaggatgcttcacaaactgaggtagataatgctatgctgtcgttggtatacatcatgaatttttatgtaaattgctctgcaaagcaaattgatatgtttgataaatttatgtttttaggtaaataaaaacttttaaaaa

SEQ ID NO: 2205 - DNA, 2865 bp, Homo sapiens
catttactgaaatgcgctctttaatttgttgtagattaggtcttgctggaagacagagaaaacttgcctttcagtattgacactgactagagtgatgactgcttgtaggtatgtctgtgccatttctcagggaagtaagatgtaaattgaagaagcctcacacgtaaaagaaatgtattaatgtatgtaggagctgcagttcttgtggaagacacttgctgagtgaaggaaatgaatctttgactgaagccgtgcctgtagccttggggaggcccatcccccacctgccagcggtttcctggtgtgggtccctctgccccaccctccttcccattggctttctctccttggcctttcctggaagccagttagtaaacttcctattttcttgagtcaaaaaacatgagcgctactcttggatgggacatttttgtctgtcctacaatctagtaatgtctaagtaatggttaagttttcttgtttctgcatctttttgaccctcattctttagagatgctaaaattcttcgcataaagaagaagaaattaaggaacataaatcttaatacttgaactgttgcccttctgtccaagtacttaactatctgttcccttcctctgtgccacgctcctctgtttgtttggctgtccagcgatcagccatggcgacactaaaggaggaggagccggggactcccaggctggagagcactgccaggacccaccactggaagcaggatggagctgactacggaactgcacactcagtgggctgtttctgcttatttcatctgttctatgcttcctcgtgccaattatagtttgacagggccttaaaattacttggctttttccaaatgcttctatttatagaatcccaaagacctccacttgcttaagtatacctatcacttacatttttgtggttttgagaaagtacagcagtagactggggcgtcacctccaggccgtttctcatactacaggatatttactattactcccaggatcagcagaagattgcgtagctctcaaatgtgtgttcctgcttttctaatggatattttaaattcattcaacaagcacctagtaagtgcctgctgtatccctacattacacagttcagcctttatcaagcttagtgagcagtgagcactgaaacattattttttaatgtttaaaaagtttctaatattaaagtcagaatattaatacaattaatattaatattaactacagaaaagacaaacagtagagaacagcaaaaaaataaaaaggatctccttttttcccagcccaaattctcctctctaaaagtgtccacaagaaggggtgtttattcttccaacacatttcacttttctgtaaatatacataaacttaaaaagaaaacctcatggagtcatcttgcacacactttcatgcagtgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctcaggactctgaaaaggaacggcttcctcattccttgtcttgataaagtggaattggcaaactagaatttagtttgtactcagtggacagtgctgttgaagatttgaggacttgttaaagagcactgggtcatatggaaaaaatgtatgtgtctcccaggtgcatttcttggtttatgtcttgttcttgagattttgtatatttaggaaaacctcaagcagtaattaatatctcctggaacactatagagaaccaagtgaccgactcatttacaactgaaacctaggaagcccctgagtcctgagcgaaaacaggagagttagtcgccctacagaaaacccagctagactattgggtatgaactaaaaagagactgtgccatggtgagaaaaatgtaaaatcctacagtggaatgagcagcccttacagtgttgttaccaccaagggcaggtaggtattagtgtttgaaaaagctggtctttgagcgagggcataaatacagctagccccaggggtggaacaactctgggagtcttgggtactcgcacctcttggctttgttgatgctccgccaggaaggccacttgtgtgtgcgtgtcagttacttttttagtaacaattcagatccagtgtaaacttccgttcattgctctccagtcacatgcccagtccacggtgaagttctgacgtgggatggtagctaattgatacgatccccaagcctggcagtgctgctatggggaggtcaaactcaccattgggtttaacccggaagagcagggctgacaccgcgcagagagtgcggaaaaggggggatttactaggaggggcggacaataggaataaa

SEQ ID NO: 2206 - DNA, 635 bp, Homo sapiens
cactaatgtctcgctctgtcacccatgctggaatatagtggcacaatcatggctcactgctccctcaacctcccaggctcaagcaatcctcccacctcagccttccgagtggctaggacttgggattacaggcatgagccaccgtgtcctgctctgattttctaccatactgataacaatggttaatgttttgatagatattccaaaattttttctgtgcttattatagaactgagattataaaaaacattcagttttataatttttgtccaaaaaattcaatcttacagcatttaccattgcataaatgtgccatcattttaaaccattctcatattgctagactttatttcttccatacttattttgctattttcactgtgatgaatatgtttgttcctaaatctttgtccaatattgctttactatttccttcaagtaaatgcatagatggagaatacatgtgtcatagatggaaaatgctatgtcaaaattcatgggcatttttatgactcttgctgtattgtccaacagcttttcagaaaggtaccaatttacaatccttcatgaaggattcactacatgttctcccctactgagtgttagcttcattcacttcacatatttgagagata

SEQ ID NO: 2207 - DNA, 325 bp, Homo sapiens
gaaggaaatagtaaagcaatattggacaaagatttaggaacaaacatattcatcacagtgaaaatagcaaaataagtatggaagaaataaagtctagcaatatgagaatggtttactatttccttcaagtaaatgcatagatggagaatacatgtgtcatagatggaaaatgctatgtcaaaattcatgggcatttttatgactcttgctgtattgtccaacagcttttcagaaaggtaccaatttacaatccttcatgaaggattcactacatgttctcccctactgagtgttagcttcattcacttcacatatttgagagata

SEQ ID NO: 2208 - DNA, 770 bp, Homo sapiens
cactaatgtctcgctctgtcacccatgctggaatatagtggcacaatcatggctcactgctccctcaacctcccaggctcaagcaatcctcccacctcagccttccgagtggctaggacttgggactacagacatgtaccaccatccccagctaatgtttttattttttgtagagatggggtttcatcatgttgcccaggctggtctcgaactcctgggctcaagcgatccgcccaccttggcctcccaaagggctgggattacaggcatgagccaccgtgtcctgctctgattttctaccatactgataacaatggttaatgttttgatagatattccaaaattttttctgtgcttattatagaactgagattataaaaaacattcagttttataatttttgtccaaaaaattcaatcttacagcatttaccattgcataaatgtgccatcattttaaaccattctcatattgctagactttatttcttccatacttattttgctattttcactgtgatgaatatgtttgttcctaaatctttgtccaatattgctttactatttccttcaagtaaatgcatagatggagaatacatgtgtcatagatggaaaatgctatgtcaaaattcatgggcatttttatgactcttgctgtattgtccaacagcttttcagaaaggtaccaatttacaatccttcatgaaggattcactacatgttctcccctactgagtgttagcttcattcacttcacatatttgagagata

SEQ ID NO: 2209 - DNA, 386 bp, Homo sapiens
atgttgaacaaatgcccttttcctgagcttttggttgagattgttgccttgaggagaggcttagggtgcaagacaaatggatcttctgggaaatggaggctcccggtgaacccgcagcatccgtgtcctgtgtatctggagtcgtcctggcagcgacaggaagtcataacatcctctcttcaaataaatctccctctggctgcctcccggctgggcagcgcatgaagcattgaagctccaatcaagctgcttgcatcccacgggaggaagcaactggctcggccccagaagaaacaggccagcctttgaagtgccagggaaagagctgcccgcaggccttgccttccccttcagaaactcgggcgtgtgccactgtgaacgggggc

SEQ ID NO: 2210 - DNA, 497 bp, Homo sapiens
tgcagtgtgcttctttcagccctgtggacacaaatttaaacagaggctttatataagtagagcaagaagaaatagttgagtcgtttgtccaaagacctccttaaagtctagtggaattagtctactgtcattttgtgttcacttaaaaaaaaagttgtgatccctatttagctgctaatcagtgataaagcatcagtgtattcaccaggtccaacccttgaggccaaagactgcaaaaggaaggtgtcagggaaaagacacagacttgttttgtgactggcatatttcaatgcttccagcatcttgacatgctcttccacttaatgctgatgccacgtggatcaataatctggctgaggtcttctttcccatgcctgatggcccaggattcctctgccctcttatgtttcaaccgagttcttactttgataagggaggctccagtaatggccttcttagccaggttgtttcctgaataagaaatcatttgggtaaaa

SEQ ID NO: 2211 - DNA, 354 bp, Homo sapiens
aaatgtttgtataaacaacaaaccaatcatccaggacttccagggcgaggcccgaggagcacacactcagaggactgctggcttctgcagggccacatcctgccccgggaccctcctcctcccctttctcctcctttctccctcccctcctcttggcacccacacaccaacattccaaacctacaagaaattccttttaatgggaagctaccccttccctaagtagcttctcagtgctgagctccaaggtagcctgggctaatgggtgtgtgaggccaagaaaaagggagctggaagctgaatcagccaaggcctgtgcccagccaggagccctgatctccaaggggaaaagcg

SEQ ID NO: 2212 - DNA, 340 bp, Homo sapiens
aaaactcagccagcctcatgtccaacatctcatgggcttgcctccagttctctgcactttccaaagtgatagctgactaatcaaagatattgtgataatgaattgcctaactacgcagcctgccttcttctcttctagcatgtatttgattaggggcctgctgaaaccaattaagtaaataattcagtatgactttatgaactacctactacatgcatggcttaacacaggcagcctcaagaggctgagaaccaaagacggaaaaagcacaacttatagtccagctatagagacagacttttaggtaagtaatcataccttgaggtgagaaaaaaaaaaa

SEQ ID NO: 2213 - DNA, 870 bp, Homo sapiens
gccagtcttctaaggatggactcttgggtgttgtcaattcttctaagcaaagcatcagtgaacactttgatgaaaggagaatgccttccttagatacctatgtaactgtcttctctttgccaagtgggtctctgctcaaatgttaccttcttagagtggccctctctgaccactgaagttgaggcggcctccccttcactctccatttcatcccattctctgatcatgcccagaaattaggagtggtggttccatatggtaaaagactttggtttgttcattgctcggttcccagaccctgcaacagtgcctggcacagaataggtgctcagatgtttattgaatgaacgacaccccgttcacccccaaagcttcttgtttcttggggttcctacttatcagagggtgcagaagttctgagtatttatatattaggcattcactctcttatttccttttttccactttctttttccttaaaacagctactcacccaccactgagagaaaaaaatagctcaggttccttcctgacccaaatttctcctcctcctttccacatgcatctgctcacaccaacgtctgtgtgctacattggatcaacaatgaaaaatgccaacttcactcctacctcttccttccctccatttctttccacctctcaacctctctgtaaaacaggtgataagctataaatgaacatttacctccctgtaggcatctcttacaagaaatttgggccaaaaagatccccctatgaattttcatgctttgaaaaagatttattgggcaaatgagtacgtatcacgaaggaaatggaaaatctactgagcctcatggggtggtgctggggaggagggagtagatggat

SEQ ID NO: 2214 - DNA, 413 bp, Homo sapiens
ccacaagaaaagggggtgagccccggaacacatatttaggaacttctttcctgtcctgactatgagctttctgagaatacggcgaatacttcaccattacacaacagagatgactgagcaagtgtggggagcatggccagctggactcgacaggattctttacccaatattaaaaacaggtcagtttttggccaggcgcggtggctcacgcctgtaatcccagcactgtgggaggccgaggtgggtggatcacctgaggtctggagttcgagaccagcctggcctacatggtgaaaccccatctctactaaaaatacaaaaaattagccgggtatggtgggaggcgcctgtaatcccagctacgtgggaggctgaagcaggggaattgcttgaacccgggggacggaggttgt

SEQ ID NO: 2215 - DNA, 787 bp, Homo sapiens
ccttcccctgtgcctaaggagaattacagatgaccacgtgtgtgttccttgccatctgggaaccagtgcatagtcatggtagcaatagcaaacacttactgggcactttttgagtggtttacatgtatcagctcacttggtccttgctacggtctgcatgtttgtgtagcctcaaaagtcatatgttgaaacctaatcaccagtgggatggtgttagaaagtggggcctttgggaagtaattaagtcatgaaagacctaccctcataaatgggacttatgcccttattttttataaaaggccccaaagacctcctttcaacacatgaagacacagtgagaagatggccatctatgaatggggaagcaggccctcgccaggcatcaaatctgctggcaccttgatcttactttccagcctccaaaactgtaaaataaatttctgttgttcataatctatgcagtttttggtattttattatagtagctcaaatggattaagacagtcctcacaacaattattcacctcattttacagatggataaactgagaggcagagaggttatgaaatatgtgaagcaaatagtaagtggcacagtagccctaggcagtgaagcgccaaagcccactctcttaaccaccgtgctggcacattgctcatatattttttacatttgtctatctgatggagagtttgtttgccctattgatttttatatcccaggactctacatgatgactgctatagtatgtgctcaataaaattatgatgaattaattagtgacaa

SEQ ID NO: 2216 - DNA, 316 bp, Homo sapiens
gatctagctttagaagaaaattgtcttcataaaatgaataatgaaaatacagatagaaaggtgaaatgattaggatgacctctagaaaaaattttgaacttccatagggatgacttgaaaactgatagcaggacaggactttatgagtctgtagtgaaggaacaaaggcataatcagtgagaatcaaaagatcagaagatctgggtgttttggaggcattataggaggaattgaaattttaaatcaggaatccaggtttaatttaaaaaatatagtagggaatagtgtagtgggctttatttaataagtgagggga

SEQ ID NO: 2217 - DNA, 388 bp, Homo sapiens
aataggatagtaatggattttttagaacattggtgttcatgtgtgttaaaaccatacatgtgagcaacaaacctagagcatgctgtggggttctaggaaaatttaaatccacagtatacatggtatattatgtatgatttcgatagttttccatgggtccctttggaaagggagacacctagcctacaggttcttcctttaaaatcaggacctgcaagggaagatgtcttttcatcgtaactgtttaataatcttgaagtaaatatgttaaggcatgaaacataaagatatgatagcttttttcaataggtatttgtccatatttgttgcatagcaggcaccataataagtgctttacatgtattaactcatctaattctcacatgca

SEQ ID NO: 2218 - DNA, 240 bp, Homo sapiens
ccgcagttccttctaatccatcaaatagtaaaacacacaaacacacaaatttattctattaaagtagataaaattgttaggtaagtataatacgtaggccatgaagggggaatagcatctatttaacaattctttattattcagaggatcatagaagtactgttgcctgcctgttgcattcaatcaagttggataaaatactgatttggaggaaactatgaaagtatttgcttacacctt

SEQ ID NO: 2219 - DNA, 346 bp, Homo sapiens
agccctgagagaagctgagggcttcaagcaatgagatttgagcctacctcccttcatcaaaagtgcagctagaaaaacttggagaagcaaccagaacgggagttgggagggtaatacttttacatcaaaacaacactagctttattggctgtaataagagcaaagtatgtaagtagaaatgatattaatctgtcatgcatatcacttctcaagtggttcctcaacaatagtgttaatcaagctttgccctacttttatcggaaacctggtgaagaatagctttgacatttatcagacataggacactaagaaaattgccatatgtataaataaatttatgccttga

SEQ ID NO: 2220 - DNA, 379 bp, Homo sapiens
ccagcctccttcatcacctccttgatccccttatcctcccctcggccctgcacctcctctctttcctgactcccacaccagagctaggcctgccctgggcacttttgcctccaggaatgaatgaggctcacagcccgaaggtgctccaagtcttggctaccttccctcagtggctgccctggcaaaggtcctgccgcagggaatcacacaaagtccagcaaagcaactggtctttcctgtccattctcacccttcccaagaaagtgtgaagagttacaatactcaggcagagctggaaaaatcatacccttttagagaatccacaagaattattggaggtgctttcactgacctgccctgccttgggtttttcaagcta

SEQ ID NO: 2221 - DNA, 747 bp, Homo sapiens
tcagcttggaaggttcactatggaagaaaatgtacccaggcaaacatccagtgacttaccacctcgccagaatagtcctcctcctgatgtgtgttttggactccattctttttataccaaacacagccctgcctcaccctcaaattctttctagtaaattatgctttggtagcatgacttcaatctacaacaaggaaatattaaaagaaccacatggcattcatatttatcataagaatgttgtagaggatgttggtcactgcacaatacgatgtctcctactagacagtagaaattatctttggtttcagccccagggatagttgtacttccccttagcagcctgtttatttttagatacacaccatgaaccatagattcttggcatttgcagatttgatctttgcatgttcagctattcaaaagagacatgtcagttgcttaactcacaaccactgtaaagccaggatgtgatatgaaactcttgctaatgagtgaacctgacatctcagtgcacgttaggacagctttgctgttcatcaacacgtgctgagggactgtcactgttcttcgccacactgtcctgtctgattccaccatcctcctcgggctggttgctaaaaagctcaaagagagttttatgccccgcttctgactgtatattctgggctctaacctcatccttcgtaacgattccatcccaatgcaaataagttagagtttctaggtgcccttcccaagggccca

SEQ ID NO: 2222 - DNA, 1451 bp, Homo sapiens
acggtctgcgcatgctcgccaggatacccctcgttaaaggcaaggcggcttctggctcttccgcaggctcagttatgggttcctgtgtgcttagtcatcgggtccgacacaggctggactgatctggggagccgcgaagggcctgccttcacaaagggacgtaacgcaagtactgcgggcagtgtttgaatatggccctgaacaatgtgtccctgtcctccggtgatcagaggagcagggtggcctaccgctcttcccatggcgacctcagaccgcgggcgtcagcgttggcgatggtctccggagacggcttcctcgtttccaggcctgaagcgattcatctaggacctcggcaggcggtgcgaccaagcgttcgggccgagagccgtcgagtggatggtggcggccggagcccaagggaaccagatggccggggccggagccgccaagccagattctcaccttacccaatccctgccgttgaacccgatctcctaagaagtgtgctgcaacagcgtttgattgcattaggaggtgttatcgcagctcgaatttcagtttaaacgaacacctttcctctggccctcacttagcttgtgaacaggcctttttaaaatcctttcttggtgtagcagcaatcgtgttgttttatttttagatggatgtattttcatttaatacgtgggagttatatgaatatgtcctagcactaagggaagtgtaacagttgattgatttaggtggttttatgcagccagaacgattggatcaggaaaggtgtggaagggatattcttaggtcgtcacaaagctgagctgatgggagcaccctccccagaggtcaacaatccattcgttaactcagacacttaacctttacctttacttctgttggcgaaaaagaagtgctcctttttattacactgatttatccttccatcttttccttggcatttaccatcttccatctcccccttcacttttttcagatatgtctacaaacagactccaatctcagtcgcactaaaaataagaacaaaacctaaaccttacagttctttcaaattattaaatcaatttattattcctttctttggcaaaggttccaaatttttactttatatttgtaattttactatttgcattcagtcccagcgcattaatctgaatctgctgtcctaaaatacactggtgaaaacattacttgtacaatctcctatcagaaaactgttcatctactcactgtagtgccctccttgaaatgtgtgtttgttcattcaactaacaatatttggggatccctgtagtaaacactgtatgaattttacacagtctggccatcaagaaagatcacggagtatattctagatggggaggctactaagtgaataggaatcaccacgctgggctgtttattaggtacagtaataaacataagtactggttgcagtg

SEQ ID NO: 2223 - DNA, 700 bp, Homo sapiens
  misc_feature (700)..(700): n is a, c, g, or t
acggtctgcgcatgctcgccaggatacccctcgttaaaggcaaggcggcttctggctcttccgcaggctcagttatgggttcctgtgtgcttagtcatcgggtccgacacaggctggactgatctggggagccgcgaagggcctgccttcacaaagggacgtaacgcaagtactgcgggcagtgtttgaatatggccctgaacaatgtgtccctgtcctccggtgatcagaggagcagggtggcctaccgctcttcccatggcgacctcagaccgcgggcgtcagcgttggcgatggtctccggagacggcttcctcgtttccaggcctgaagcgattcatctaggacctcggcaggcggtgcgaccaagcgttcgggccgagagccgtcgagtggatggtggcggccggagcccaagggaaccagatggccggggccggagccgccaagccagattctcaccttacccaatccctgccgttgaacccgatctcctaagaagtgtgctgcaacagcgtttgattgcattaggaggtgttatcgcagctcgaatttcagtttaaacgaacacctttcctctggccctcacttagcttgtgaacaggcctttttaaaatcctttcttggtgtagcaaaaaaattcactggccgtcgtttacaactgtgtgactggcccctgcgttacccactttcgctttgn

SEQ ID NO: 2224 - DNA, 1986 bp, Homo sapiens
acggtctgcgcatgctcgccaggatacccctcgttaaaggcaaggcggcttctggctcttccgcaggctcagttatgggttcctgtgtgcttagtcatcgggtccgacacaggctggactgatctggggagccgcgaagggcctgccttcacaaagggacgtaacgcaagtactgcgggcagtgtttgaatatggccctgaacaatgtgtccctgtcctccggtgatcagaggagcagggtggcctaccgctcttcccatggcgacctcagaccgcgggcgtcagcgttggcgatggtctccggagacggcttcctcgtttccaggcctgaagcgattcatctaggacctcggcaggcggtgcgaccaagcgttcgggccgagagccgtcgagtggatggtggcggccggagcccaagggaaccagatggccggggccggagccgccaagccagattctcaccttacccaatccctgccgttgaacccgatctcctaagaagtgtgctgcaacagcgtttgattgcattaggaggtgttatcgcagctcgaatttcagtttaaacgaacacctttcctctggccctcacttagcttgtgaacaggcctttttaaaatcctttcttggtgtagcagcaatcgtgttgttttatttttagatggatgtattttcatttaatacgtgggagttatatgaatatgtcctagcactaagggaagtgtaacagttgattgatttaggtggttttatgcagccagaacgattggatcaggaaaggtgtggaagggatattcttaggtcgtcacaaagctgagctgatgggagcaccctccccagaggtcaacaatccattcgttaactcagacacttaacctttacctttacttctgttggcgaaaaagaagtgctcctttttattacactgatttatccttccatcttttccttggcatttaccatcttccatctcccccttcacttttttcagatatgtctacaaacagactccaatctcagtcgcactaaaaataagaacaaaacctaaaccttacagttctttcaaattattaaatcaatttattattcctttctttggcaaaggttccaaatttttactttatatttgtaattttactatttgcattcagtcccagcgcattaatctgaatctgctgtcctaaaatacactggtgaaaacattacttgtacaatctcctatcagaaaactgttcatctactcactgtagtgccctccttgaaatgtgtgtttgttcattcaactaacaatatttggggatccctgtagtaaacactgtatgaattttacacagtctggccatcaagaaagatcacggagtatattctagatggggaggctactaagtgaataggaatcaccacgctgggctgtttattaggtacagtaataaacataagtactggttgcagtgactttttttttttttttttcatcataatactgcactatcctggttcttctcttacctggctgatcactccttatttgctgttatttttgttctcttaaccatacatttcccaatgtttaaagggtggtattttgagaaagttaatgggttttgtaagtgccagctctttatataagcaggtagactagctttttcccagcagacgcttgtctgtttagacttccttaaaataattatcttcaaataaagcaaaatctccatacaccacatagtattgaattgttataactacgtgttaagaagaatgttgagtaaacaagatagcttccataagagggtgattaatatagtgagaattctagaaaccagatcataggaagaatgattgaaagaatagtaatagctaccttttattgagtgctatgtgcaagtcagtgtgctaggacttttattgtttatagagatatttattgagaacttactctgtacctgctactgcctgcggtaagcacttagaataaagtggtgaacatga

SEQ ID NO: 2225 - DNA, 2265 bp, Homo sapiens
acggtctgcgcatgctcgccaggatacccctcgttaaaggcaaggcggcttctggctcttccgcaggctcagttatgggttcctgtgtgcttagtcatcgggtccgacacaggctggactgatctggggagccgcgaagggcctgccttcacaaagggacgtaacgcaagtactgcgggcagtgtttgaatatggccctgaacaatgtgtccctgtcctccggtgatcagaggagcagggtggcctaccgctcttcccatggcgacctcagaccgcgggcgtcagcgttggcgatggtctccggagacggcttcctcgtttccaggcctgaagcgattcatctaggacctcggcaggcggtgcgaccaagcgttcgggccgagagccgtcgagtggatggtggcggccggagcccaagggaaccagatggccggggccggagccgccaagccagattctcaccttacccaatccctgccgttgaacccgatctcctaagaagtgtgctgcaacagcgtttgattgcattaggaggtgttatcgcagctcgaatttcagtttaaacgaacacctttcctctggccctcacttagcttgtgaacaggcctttttaaaatcctttcttggtgtagcagcaatcgtgttgttttatttttagatggatgtattttcatttaatacgtgggagttatatgaatatgtcctagcactaagggaagtgtaacagttgattgatttaggtggttttatgcagccagaacgattggatcaggaaaggtgtggaagggatattcttaggtcgtcacaaagctgagctgatgggagcaccctccccagaggtcaacaatccattcgttaactcagacacttaacctttacctttacttctgttggcgaaaaagaagtgctcctttttattacactgatttatccttccatcttttccttggcatttaccatcttccatctcccccttcacttttttcagatatgtctacaaacagactccaatctcagtcgcactaaaaataagaacaaaacctaaaccttacagttctttcaaattattaaatcaatttattattcctttctttggcaaaggttccaaatttttactttatatttgtaattttactatttgcattcagtcccagcgcattaatctgaatctgctgtcctaaaatacactggtgaaaacattacttgtacaatctcctatcagaaaactgttcatctactcactgtagtgccctccttgaaatgtgtgtttgttcattcaactaacaatatttggggatccctgtagtaaacactgtatgaattttacacagtctggccatcaagaaagatcacggagtatattctagatggggaggctactaagtgaataggaatcaccacgctgggctgtttattaggtacagtaataaacataagtactggttgcagtgactttttttttttttttttcatcataatactgcactatcctggttcttctcttacctggctgatcactccttatttgctgttatttttgttctcttaaccatacatttcccaatgtttaaagggtggtattttgagaaagttaatgggttttgtaagtgccagctctttatataagcaggtagactagctttttcccagcagacgcttgtctgtttagacttccttaaaataattatcttcaaataaagcaaaatctccatacaccacatagtattgaattgttataactacgtgttaagaagaatgttgagtaaacaagatagcttccataagagggtgattaatatagtgagaattctagaaaccagatcataggaagaatgattgaaagaatagtaatagctaccttttattgagtgctatgtgcaagtcagtgtgctaggacttttattgtttatagagatatttattgagaacttactctgtacctgctactgcctgcggtaagcacttagaataaagtggtgaacatgaaaaaagtatgtgttcctaaggaactttatatgttatttgattctcacagcagcccataagaggggtactctactttcattttgttactgaaaaacagcgtgaaggagataaactttccaaggtcatatagctagtaaatgatagagccctgcagcctttcaaatgaggttcctcatctgaatgcaaaaaaaatgacttgagtaactattttctcaattttcccaaggataatatataactaattttttttcagataactaaaaagaagttagtttgtaa

SEQ ID NO: 2226 - DNA, 1713 bp, Homo sapiens
acggtctgcgcatgctcgccaggatacccctcgttaaaggcaaggcggcttctggctcttccgcaggctcagttatgggttcctgtgtgcttagtcatcgggtccgacacaggctggactgatctggggagccgcgaagggcctgccttcacaaagggacgtaacgcaagtactgcgggcagtgtttgaatatggccctgaacaatgtgtccctgtcctccggtgatcagaggagcagggtggcctaccgctcttcccatggcgacctcagaccgcgggcgtcagcgttggcgatggtctccggagacggcttcctcgtttccaggcctgaagcgattcatctaggacctcggcaggcggtgcgaccaagcgttcgggccgagagccgtcgagtggatggtggcggccggagcccaagggaaccagatggccggggccggagccgccaagccagattctcaccttacccaatccctgccgttgaacccgatctcctaagaagtgtgctgcaacagcgtttgattgcattaggaggtgttatcgcagctcgaatttcagtttaaacgaacacctttcctctggccctcacttagcttgtgaacaggcctttttaaaatcctttcttggtgtagcagcaatcgtgttgttttatttttagatggatgtattttcatttaatacgtgggagttatatgaatatgtcctagcactaagggaagtgtaacagttgattgatttaggtggttttatgcagccagaacgattggatcaggaaaggtgtggaagggatattcttaggtcgtcacaaagctgagctgatgggagcaccctccccagaggtcaacaatccattcgttaactcagacacttaacctttacctttacttctgttggcgaaaaagaagtgctcctttttattacactgatttatccttccatcttttccttggcatttaccatcttccatctcccccttcacttttttcagatatgtctacaaacagactccaatctcagtcgcactaaaaataagaacaaaacctaaaccttacagttctttcaaattattaaatcaatttattattcctttctttggcaaaggttccaaatttttactttatatttgtaattttactatttgcattcagtcccagcgcattaatctgaatctgctgtcctaaaatacactggtgaaaacattacttgtacaatctcctatcagaaaactgttcatctactcactgtagtgccctccttgaaatgtgtgtttgttcattcaactaacaatatttggggatccctgtagtaaacactgtatgaattttacacagtctggccatcaagaaagatcacggagtatattctagatggggaggctactaagtgaataggaatcaccacgctgggctgtttattaggtacagtaataaacataagtactggttgcagtgactttttttttttttttttcatcataatactgcactatcctggttcttctcttacctggctgatcactccttatttgctgttatttttgttctcttaaccatacatttcccaatgtttaaagggtggtattttgagaaagttaatgggttttgtaagtgccagctctttatataagcaggtagactagctttttcccagcagacgcttgtctgtttagacttccttaaaataattatcttcaaataaagcaaaatctccata

SEQ ID NO: 2227 - DNA, 1065 bp, Homo sapiens
cggggcgacctacaggacctcgttactggcatttaccatcttccatctcccccttcacttttttcagatatgtctacaaacagactccaatctcagtcgcactaaaaataagaacaaaacctaaaccttacagttctttcaaattattaaatcaatttattattcctttctttggcaaaggttccaaatttttactttatatttgtaattttactatttgcattcagtcccagcgcattaatctgaatctgctgtcctaaaatacactggtgaaaacattacttgtacaatctcctatcagaaaactgttcatctactcactgtagtgccctccttgaaatgtgtgtttgttcattcaactaacaatatttggggatccctgtagtaaacactgtatgaattttacacagtctggccatcaagaaagatcacggagtatattctagatggggaggctactaagtgaataggaatcaccacgctgggctgtttattaggtacagtaataaacataagtactggttgcagtgactttttttttttttttttcatcataatactgcactatcctggttcttctcttacctggctgatcactccttatttgctgttatttttgttctcttaaccatacatttcccaatgtttaaagggtggtattttgagaaagttaatgggttttgtaagtgccagctctttatataagcaggtagactagctttttcccagcagacgcttgtctgtttagacttccttaaaataattatcttcaaataaagcaaaatctccatacaccacatagtattgaattgttataactacgtgttaagaagaatgttgagtaaacaagatagcttccataagagggtgattaatatagtgagaattctagaaaccagatcataggaagaatgattgaaagaatagtaatagctaccttttattgagtgctatgtgcaagtcagtgtgctaggacttttattgtttatagagatatttattgagaacttactctgtacctgctactgcctgcggtaagcacttagaataaagtggtgaacatga

SEQ ID NO: 2228 - DNA, 2086 bp, Homo sapiens
tatactataacacttggctatatgtaggcaatgtcactactgggcaaatacacttactgtgttctagaggcagccctttcttatgcagaaaatacaatacgcactgcatgagaagcttgagagtggattctaatccaggtctgtcgaccttggatatcatgcatgtgggaaggtgggtgtggtgagaaaagttttaaggcaagagtagatggccatgttcaactttacaaaatttcttggaaaactggcagtattttgaactgcatcttctttggtaccggaacctgcagaaacagtgtgagaaattaagtcctggttcactgcgcagtagcaaagatggtcaaggccatggaaaaagcagaaatttaccaagaaagctgatacccatgtatagttcccactcatctcaaatacatctgctatctttttaagctaagtcctagacatatcggggataacatgggggttgattagtgaccacagttatcagaagcagagaaatgtaattccatattttatttgaaacttattccatattttaattggatattgagtgattgggttatcaaacacccacaaactttaattttgttaaatttatatggctttgaaatagaagtataagttgctaccattttttgataacattgaaagatagtattttaccatctttaatcatcttggaaaatacaagtcctgtgaacaaccactctttcacctagcagcatgaggccaaaagtaaaggctttaaattataacatatgggattcttagtagtatgtttttttcttgaaactcagtggctctatctaaccttactatctcctcactctttctctaagactaaactctaggctcttaaaaatctgcccacaccaatcttagaagctctgaaaagaatttgtctttaaatatcttttaatagtaacatgtattttatggaccaaattgacattttcgactattttttccaaaaaagtcaggtgaatttcagcacactgagttgggaatttcttatcccagaagaccaaccaatttcatatttatttaagattgattccatactccgttttcaaggagaatccctgcagtctccttaaaggtagaacaaatactttctatttttttttcaccattgtgggattggactttaagaggtgactctaaaaaaacagagaacaaatatgtctcagttgtattaagcacggacccatattatcatattcacttaaaaaaatgatttcctgtgcaccttttggcaacttctcttttcaatgtagggaaaaacttagtcaccctgaaaacccacaaaataaataaaacttgtagatgtgggcagaaggtttgggggtggacattgtatgtgtttaaattaaaccctgtatcactgagaagctgttgtatgggtcagagaaaatgaatgcttagaagctgttcacatcttcaagagcagaagcaaaccacatgtctcagctatattattatttattttttatgcataaagtgaatcatttcttctgtattaatttccaaagggttttaccctctatttaaatgctttgaaaaacagtgcattgacaatgggttgatatttttctttaaaagaaaaatataattatgaaagccaagataatctgaagcctgttttattttaaaactttttatgttctgtggttgatgttgtttgtttgtttgtttctattttgttggttttttactttgttttttgttttgttttgttttgttttgcatactacatgcagttctttaaccaatgtctgtttggctaatgtaattaaagttgttaatttatatgagtgcatttcaactatgtcaatggtttcttaatatttattgtgtagaagtactggtaatttttttatttacaatatgtttaaagagataacagtttgatatgttttcatgtgtttatagcagaagttatttatttctatggcattccagcggatattttggtgtttgcgaggcatgcagtcaatattttgtacagttagtggacagtattcagcaacgcctgatagcttctttggccttatgttaaataaaaagacctgtttgggatgta

SEQ ID NO: 2229 - DNA, 2372 bp, Homo sapiens
tatactataacacttggctatatgtaggcaatgtcactactgggcaaatacacttactgtgttctagaggcagccctttcttatgcagaaaatacaatacgcactgcatgagaagcttgagagtggattctaatccaggtctgtcgaccttggatatcatgcatgtgggaaggtgggtgtggtgagaaaagttttaaggcaagagtagatggccatgttcaactttacaaaatttcttggaaaactggcagtattttgaactgcatcttctttggtaccggaacctgcagaaacagtgtgagaaattaagtcctggttcactgcgcagtagcaaagatggtcaaggccatggaaaaagcagaaatttaccaagaaagctgatacccatgtatagttcccactcatctcaaatacatctgctatctttttaagctaagtcctagacatatcggggataacatgggggttgattagtgaccacagttatcagaagcagagaaatgtaattccatattttatttgaaacttattccatattttaattggatattgagtgattgggttatcaaacacccacaaactttaattttgttaaatttatatggctttgaaatagaagtataagttgctaccattttttgataacattgaaagatagtattttaccatctttaatcatcttggaaaatacaagtcctgtgaacaaccactctttcacctagcagcatgaggccaaaagtaaaggctttaaattataacatatgggattcttagtagtatgtttttttcttgaaactcagtggctctatctaaccttactatctcctcactctttctctaagactaaactctaggctcttaaaaatctgcccacaccaatcttagaagctctgaaaagaatttgtctttaaatatcttttaatagtaacatgtattttatggaccaaattgacattttcgactattttttccaaaaaagtcaggtgaatttcagcacactgagttgggaatttcttatcccagaagaccaaccaatttcatatttatttaagattgattccatactccgttttcaaggagaatccctgcagtctccttaaaggtagaacaaatactttctatttttttttcaccattgtgggattggactttaagaggtgactctaaaaaaacagagaacaaatatgtctcagttgtattaagcacggacccatattatcatattcacttaaaaaaatgatttcctgtgcaccttttggcaacttctcttttcaatgtagggaaaaacttagtcaccctgaaaacccacaaaataaataaaacttgtagatgtgggcagaaggtttgggggtggacattgtatgtgtttaaattaaaccctgtatcactgagaagctgttgtatgggtcagagaaaatgaatgcttagaagctgttcacatcttcaagagcagaagcaaaccacatgtctcagctatattattatttattttttatgcataaagtgaatcatttcttctgtattaatttccaaagggttttaccctctatttaaatgctttgaaaaacagtgcattgacaatgggttgatatttttctttaaaagaaaaatataattatgaaagccaagataatctgaagcctgttttattttaaaactttttatgttctgtggttgatgttgtttgtttgtttgtttctattttgttggttttttactttgttttttgttttgttttgttttgttttgcatactacatgcagttctttaaccaatgtctgtttggctaatgtaattaaagttgttaatttatatgagtgcatttcaactatgtcaatggtttcttaatatttattgtgtagaagtactggtaatttttttatttacaatatgtttaaagagataacagtttgatatgttttcatgtgtttatagcagaagttatttatttctatggcattccagcggatattttggtgtttgcgaggcatgcagtcaatattttgtacagttagtggacagtattcagcaacgcctgatagcttctttggccttatgttaaataaaaagacctgtttgggatgtaaaaaaaaaaaaaaaaaaaaaaaaggagagcgaggacgggcaaaaacagcagagaggagaaaggaagagcaacagaaagagagaacgagagaggaggagcaggccagcgaggcggaggagagggaagcaagcagcgggcgcgcggcgaagacagggcgcggcgcagcagcaggagagggggggaggcgggcgggacgggagggggggacccgagaggagcgggaagaggaggggcgggcaggaagggccgcggaggaggggaggaacgaagcgaagcggggaggaga

SEQ ID NO: 2230 - DNA, 467 bp, Homo sapiens
attattagaagactagattattgctcagcagtaaccactcctttcccacaaactcccctctctaggaggaatgtacctccccacccattcctgttaggcttggccaggtgaatcgctttggccaatagaatgtaactgacaaggtgagcagagatttgcagtgggcttgtgcttggtgctggtcctccggggctcctgcctttagccaggggaagcacactccccagcccctccttagccctctggccctggggagaatgagaggcatgtggcacagtcctggacccagccgtggctgggagcaagcctggaagcttgagcgagagataaatgcttggtctttttgtttgagactaagtctcgctctatcgcccaggctggagtgcagtgagccgagactgcagcattgcactccagcctgcgcaacaagagtgaaactgtctcataaaacaaaacaaaacaataca

SEQ ID NO: 2231 - DNA, 659 bp, Homo sapiens
gggtttcaccgtattggtcagacttgtcttgaactcatgacctcttgatccacctgccttggcctcccaaggtgctgggattacaggcgtgagccactgtgcccagctgatttatgtttttcaaagatctcttcagctgctgtggtgagagtggaagcagcgagatcagttgggggctttactgtggcccagatgagaaatgaggatagtctcctttggtttaatttttttttttttgagacgggatctcactctgttgcccagtctagagtgcaatggagcaatcatggctcactgcagcctctaccttccagcctcaaggaccctcctgcctcagcctcctgaggaggatagtcttcttattctgaaatggttaggatgagcacagcagaaagaaaggaggagtgggtccaaacctcatacctgtctccttctgtctcatcccatctgctgccaggattcccatggtgagggatttcctagtggagtcaggagatataggtgaatgggtgggtgtcagattcactacagtggcagaaaggaggaggagatgaaggtacccagtactgtggccacccaagtccccttttacaccaccaatcttctaacctttcctgaacacgaatgatgaggatgcagattaaaaacaacaaatatgc

SEQ ID NO: 2232 - DNA, 393 bp, Homo sapiens
taaaaaataaatttaaaaaagaggtaaatgtggactattatacagcctccttgatgatttgtatgcacaaaggcctaagaaaggctctgagaagtcctgtaattagatttaaaaaataaacaaacagaaacctgtaaaacctagcattttccaaacttacttgaccaaagaccccttttttctcttagcacctgttgatagcttatggccatcctatggaacttatggctacatgttcttgtttacttattatgtcactggaatataagctgtgtgtaagcagtaatactgtcttgttcagtacagtatccttgacacctagaacagtatctgacatggtgtttgatccatatttgatgaatgaaaataaactgaacaagtgaatgaactctg

SEQ ID NO: 2233 - DNA, 255 bp, Homo sapiens
gattcgatggattcatagatgtatgtatgcttaggtaggtaaatgaattggtacctatataccttctttatcctattttaccctctcagaagtcattatcttatgaaagcatcaggctttctccagaaaatgtctcacatgcatgtttgatcagtatttctttctgttatataaagctttgtcttctattcccattgtaaatagacatgcttaggaaaataatactttggaaatgttgacatatcccataaaaat

SEQ ID NO: 2234 - DNA, 419 bp, Homo sapiens
gttaatttttgctacatttacaagattttaatattgcttcctatcacaatatattttttaactagttacttttcacatttcaaaaaatcgtttcaaaaatgatacctaattttaaggatgtattgccaaagcttcaagaaatcgaataaaattaaagacatatatcaaccagttggttttctagatatagaggttgtgaaaatcaatttacactgcagaaaaacatgcataatgggccaatttgtaacatagattcaggaaacaaaatagtaaaaaacatgagcctatacaaataaaaggaaaatatttttccaagaatgaattctatggattataaatttacttgtatccaagaaagttataaagaagatatttcagaggattaagattaaaaattaaagataattcaaaatcagaat

SEQ ID NO: 2235 - DNA, 424 bp, Homo sapiens
atcaattgaagaagggatgaatcagaagcattagctaaagtagtggctttctttgatggtgttttaccaagaggaggaatcagatcaggtcccaccacagtatgcaggctgagatgattcatcttttccaaaaactgagactatcaggagaacaaagtaattcttctttttctgcatatggctatgctgtattcttcattacttcatgagtgtatgaatttgctaggactgctgttacaaagtgctacagactgggtggcttcactatggaaatttactttctcacagtcccggaggtcagaattccaagatcaaggtgtcagcagagttgattccttttgaggcctccctccttgacttatagatggtcaaggagatgtaccttattatgtttcctctgtaggtgtttgtgttcagagttgat

SEQ ID NO: 2236 - DNA, 596 bp, Homo sapiens
cttttgatttgttttaaatttgttttcagaaccatggcctgtggtcacttaatcagcaaccctggttcggtaagtggtatgttttctatagcattattataggtctacctgcaaggtggtgcgctatgggcagtaaacgtttctggaaaaacaactagtatagtagtgtgggaagtcgactttgaaaaattcactcaacctctattgcctcaatttccttatttgtgaagaggagggaatccagatatctctgagggtgtacttaaaataaaaatctgtggaaccaaatatattttttgttctttctctatttttttaagcatctgtctgacctatgtagcccaaaggaggtctctgctctgtggttacttttgaggactatcttgccaagtggtacttatttttccaaaaagacattagcagaagctcaacgaagtgatctgcaaataatttaaaatgcagtaatttttagcactggaagattagccatttgccattgggtcttttcaatgcaagcaggagtgttagagtaatgttaaaaacaccataaagcccatgagaacacagagaatgctctccagccatacagtttcagc

SEQ ID NO: 2237 - DNA, 895 bp, Homo sapiens
cagacactggggtctacttgagggtggagggtgagaaaaggaagagaaacagaaaagataactattgggtactaggtttaatacctgggtgatgaaataatctgtacaataaccccctgtgacaccagtttacctatgtaacaaatgcccctaaacttaaaataaaataaaaaataaaaaaaattataaatgtcagtctaccaaaatagattaaaagtgtaggtgggaattaaatggggataaacactcaataaatgttagctatatatgaatattgccaatactgaaaagattccattgttcaaaaaagtttgagaagcaatgggttaaacaaaatggaacctgctctgcagaatctgtgtgttcctttacatcatactctccatggtagagtgtaggggatgggcgccatgtctccctagtacgtttgaccttgggattctttgtctgtgaacatctttgggttctagtgttcagcagcacttagggaggcactgaattcagtgtacctttggtctagcctcagccctgattctgttctgcggtgggccctggccttcaagagaacagatatctaaaagttgaaagaaaagatcggccgggcgcggtggctcacgcctgtaatcccagcactttgggaggccaaggcgggtggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacccgggaggcagagcttgcagtgagccgagattgcgccactgcactccagcctgggtgacagagtgagactccgtctcaaaaaaaaaaaaaaaaaa

SEQ ID NO: 2238 - DNA, 333 bp, Homo sapiens
cactaccccaataatttagttttattctcacaaattacctgtcactttcttcagaccgtttggttttacaaagtacttcctagtacatttaaaaacttatgttttgatagtgtctttgccacctatgatgtgcaaaatctaagaaaactatcatacctattcttcgtttcagacaatctcatcctgctgacaatgaagaaaaatctgtattatttcagtgctttgtaaaaagaattttgcatcagttggaataacaagaccaaaatttaacaacaaataacaaagagtatacatcttatagaagggattacattcctcatttcatagtttaaa

SEQ ID NO: 2239 - DNA, 422 bp, Homo sapiens
ccgggaagggggtgggtgttggggggcaaaagcctgatttttgtgttcaaaaaaaaaatgtttttgcagctgaccagctgtatgccaaacagtaacagtaccattaccaatgaacacccttaaaatatgaggaatcaagactgttgacctttgggtgaaaagcgagtgattcaggacccaagtgattgagtagctccgatcaggtctggttttatctcttcctgataacacagcattggttgttacagggacaaaagcaggagtgatgtatttggctaaatctttaatcaataaaatagattaaggatcatgaatatggagttttcttttccccttaggatactttacttatactgtgctacaatttagtcccaaatgcactttcagtgaattaggaaaagctgtcacttccttaatcttgt

SEQ ID NO: 2240 - DNA, 82 bp, Homo sapiens
ctacaatgaggatggcaagtctggacaacagccagcttagaagattcttatctcttgggcactgcagccagacttcacacat

SEQ ID NO: 2241 - DNA, 803 bp, Homo sapiens
  misc_feature (16)..(16): n is a, c, g, or t
  misc_feature (24)..(24): n is a, c, g, or t
  misc_feature (42)..(42): n is a, c, g, or t
tactgcagtaaacccncgatttantgtagcgaggctggtggngccacccactgccaccccataggccatggcacagacagggctggggatgctccctggcacggaccaccataggaagtcagccctggaacccgtgggctgtggaggcctggtcttagaaccagtaggtcctggagggtcagtaagtctgggccctaggatcctatcttgctagaggccagatctgatccagccccctcattttgcagaggcagaaactgaggctggaaagaaaaatcataaccctcacacctgctcttttctgacagccagtcataggcagggcttggcacgtggttgttttcgtttctcattcctagcctgatgcagtggctcacgcctgtaatcccagcactttgggaggctgaggcgggcaaatcaattgaggtcaggagtttgagaccagcctggccaacacggtgaaaccctgtctctactaaaaatacaaaaattagctgggcgttgtggtgcacgcctgtagtcccagctagttgggaggctgaggcaggagaatcacttgaactggggaggcaaaggttgcagtgagccgagatcgcgcaactgcactagagactccatctcaaaaaaaaattaaaaattagctgggcttggtggcatgcgcctcccgtcccagttactcaggaggctaaggtgggaggattgattgcttgcgtccaggaggtagaggctgcagtgagccaagatcgaaccactgcactccagcctgggtgacagagtgagaccctattccaaaaaaaaaaaaa

SEQ ID NO: 2242 - DNA, 253 bp, Homo sapiens
gcccagcccctggctggtaggggaggctattggaagagagcaaagacctcttccaggcagtgctacagaggtcaggaggcagaactaatggtgggatattctgggaagccaggaagggctggggatgaaggtctgaccaggtgcttacaaaggggccctgaatctctgtgctaccagcttaatttcctgaaatgtcactaaagaaccaacattattggcagccagcccagcccatgtgacccaatgttattta

SEQ ID NO: 2243 - DNA, 894 bp, Homo sapiens
tttatggatgaggctgcactagggcagaggcagagttgcctgagtgcctggaacgcagctcgcttcctcagcagggtgtgggcaatgccaccagatggttaggggaaaaaagaggccatctctcagggaatgcgtgttcctgctgagcatggaggaaaggaaggtgaggcagctttggaactcaacaaattttattaaacctgtcagttagagagccattgttggtacaacagcaccatctgctgttagtttagagcaactgctaggagctactagcatacctgcataattgctgggagggattttattaatttatatttttgttattcaagcaatatctcttgagaacctactgctgtggagcacagggaagcagacgaggacaaggtaaaaacagtcctcatccatatggagttgtagtctacaagtctggttcttgggtctgaaacctgactgcacatcccagtcacctgaggaactttctgcacatcccagtcacctgaggaactttttctgactcctgaccagtgtggaatctgtctttcaaaaagcttcccagtcgattgagatgcagcctgcccatggagtggagaagtctgtggtccatgtgaactactgatctagtacaactctttccctttacaaatagggaaactgaggcccagaaaggggaagggtcacccagtgagcaagtcagagagacaggtccagaacacaggtgtcctagctaccaggtcagttgcactttctagatactgtgctgtcttccttctttatggctttcatcttcttgtgtataaaaggattttaaaagattatactaaaacttgtaaacgaagcaattctagcactcagctcaggctgatcaacacggtgagtgatctgataatgccc

SEQ ID NO: 2244 - DNA, 1010 bp, Homo sapiens
  misc_feature (249)..(249): n is a, c, g, or t
  misc_feature (291)..(291): n is a, c, g, or t
tttatggatgaggctgcactagggcagaggcagagttgcctgagtgcctggaacgcagctcgcttcctcagcagggtgtgggcaatgccaccagatggttaggggaaaaaagaggccatctctcagggaatgcgtgttcctgctgagcatggaggaaaggaaggtgaggcagctttggaactcaacaaattttattaaacctgtcagttagagagccattgttggtacaacagcaccatctgctggganaggttatacgaagtcaacatgacatagtgacgctaacgtaanccatagcgctgacagtacatttgcttgggaggggactttgtacttaagtttactaatttgtatgtatactctcaatggcatagtactcgtcgttgaatgaacccttacactgactgttgcgtagccaccaggaggaacgtcatgaccgaaaggatcaagggttacatagaaccagtgtcctcactccactatggaggctgtgtacgctcttaccacatgctcctggggttcctttgcgggtcatcgacaagcacttcgacgtgggcagcactcccaggtgcaaccatgagggaacttgctggcacaatcgcacagtcaagcgcgtgagggaactttttctgactcctgaccagtgtggaatctgtctttcaaaaagcttcccagtcgattgagatgcagcctgcccatggagtggagaagtctgtggtccatgtgaactactgatctagtacaactctttccctttacaaatagggaaactgaggcccagaaaggggaagggtcacccagtgagcaagtcagagagacaggtccagaacacaggtgtcctagctaccaggtcagttgcactttctagatactgtgctgtcttccttctttatggctttcatcttcttgtgtataaaaggattttaaaagattatactaaaacttgtaaacgaagcaattctagcactcagctcaggctgatcaacacggtgagtgatctgataatgccc

SEQ ID NO: 2245 - DNA, 394 bp, Homo sapiens
tgttttctttgggtccatttgttcttctgtttttctgctcgatccaagtgctcagatgtgctttgttcgaccctctccatccaggtgttcacccttctctgtccaggtcacctgcaaactcagggtgagatttgcaatgccagcttgagacagtttccatggcgtgaagtgggatttgtcatgaaattctcagcacaaccaatacgttttctctttttatctaatgtcaaaatatagctgtttgcaatttttgtctcctatttgagttttgtgtttgactttgttatttagggaccaagagtttataaaaagtctggcttgaagcagcctggaggtaactgcctggaggcccctggctcagtggagggagcacagaccaggtcttttcttgtgt

SEQ ID NO: 2246 - DNA, 421 bp, Homo sapiens
tggggggagcgggcaagcatggggagatgagatgtgtatatgtgagagagagtgtgggggccccaggcagggcaggaggtggtggaaacggggtgaactccgtgggctgtgtgaggactgtccatagtgggtcccaaccccctccctctgctggagtttcctagcccttccccctccccaagactgtggcagcaggcaggagcccctgccctccctccctgtcctgtgccacacttctggggccaaacccagcccccttgagccaggccctgccagactccaagcccaccctagaaccctcctcctgtgtggagactctgttgccccactttggacacagattggcaacctgcctcaccccgccccccttcgctggggcttccatcttaatttattctcaataataaagacttcatgatga

SEQ ID NO: 2247 - DNA, 270 bp, Homo sapiens
ggaggacccttgctgtctctcaccggccaaggaaggttagatgtgggtgtccccaggggcccaggggtgacgatgtgggtatagtgacaacagttagagttgctttcacatgtggcgtgattcctatgtgcctgatggtattaccagttgttacctacattaaccttatcataatggaatgaggaagccagaggaaccaaggctttgattcttttatttatccattttcataataatgagttggttcctttccctcctccagagaggacc

SEQ ID NO: 2248 - DNA, 1137 bp, Homo sapiens
acaaaatgcttaatttaaatggaattttaatttataaaattttaaactctccacaagtactggccgtgggcaaatacagaaaatcagattaaaaaaataaatggataagggaaaattaaaattgcatgactgtcttttagtctaagagggatcttatgaggatgctcaacagttaacagtacatgtttagagagaaccaaacaagaggctacgtcttaaagcagaatagattgtggttgggcataaggagactattgattgcttgaagacacagacagctcaaggaaaattggacatagagctgaaaagtgatgtttttgacaaagaattgttctgcacatccagctgtggaggaatccttaaggctcacagaggaacaaacaagaagcagtcttcagagatcaggggcggaatccccaatgtcaggagcaaggttgctgtggggaaattctactcttcctatctttcctgaactggaattaaaaagcacctaaatccagaaggtaaaggatgagacagcaagagagggggaagaattccggagttttattaaagtaggaaggaacttctcatctatttggaaatgattctctgaggtcccgctggaaagagttttaaaaaatttactctggccaaaatgccttccttgttgtcaaatcagcacaaagttaaggttaaacatagcttaagacctgttctctttagttttctcacaaccacttaaaactgtcataacgtaccaccagtttatatacaatcatatttacaaaaaaaacacgcaaaatattaatccaaaatagttttttttaatcctttgaagttataccatcaaacttgatggtagttattttaataggtattcttgtgcatacttcttaagtgtacttttatctttaatgcataacttttgaaattaagaggaaaaacagcaagcaggaaggatacaatgcaataagcatttgattttgttctaaatgagcagctttaaaaaaaaaaggtaaaatacattaaacaaagtgcatcagttccaacaagttagtattaaaaagaggcctaaggacagtgctggaaccagccaggagtccctccctggcaggcctctgattgtcttcagagaatattcaatgaaaaaaaaaa

SEQ ID NO: 2249 - DNA, 1024 bp, Homo sapiens
tgatacggagtcttgctctgttacccaggcagtgcagtggtatgatctcagcttattgccacctccacttcctgggttcaaccgattctcctgcttcagcctcccaggtagctgggactacaggctgctgccaccacatccagctaatttttgtatttttagtagagaccgggtttctccgtgttggccaggctggtcatgaactcctgacctcaaatgatcgggtcgccttggcctcccaaagtgctgcagttacaggcatgagccacatgcctggccggcaaagagattttacgtgggaaactgatcaaataattacaatatacagaaactgtaattgtatttagattattgtgatgtaaaggggatacaggcttttttcctttgggtacaaatagagatggactgttttctatttaaataccattaaaaattgttatacttttctactttgcctgtgacatgtagtggtttttcaggcttatattctctcttccagctcaaagctctcatttaatgaaataatttgaaataaaacttgatttaaaacttgtttttcttatttgatttaatattgtctcctgccgtatttttttggtcttgttttctcttgtatagggtagagggcagtggtgagatcatggctcacagcagcctcaacctcctagactcaagcagtcttcctacctaagccactgcccacctccccctaatcccccaggagctgggactataggtgtgtaccatatggcccgactatatatatattttattttttgttgcctaggctgtgtactaacatttttattctgaagttaaatacatcccatctgtgaacttgtcaaacatcatgcactgaactattttaaattctactcaggagacatttcttaaaaacctattataaggctaagtgtggtagctcacacctgtaatctcacaaggccaaggtaggattgcatgtgtccaggaatttgagaccatcctgggcaacatagcaagacttcatctctaccaaaaaaaa

SEQ ID NO: 2250 - DNA, 180 bp, Homo sapiens
gaattgcattttgtatgaagttgggaaagaagtcatgtacatggggcattctcataactacatgtttagtatttgagtggctgtgctttctagagaattttgttaatatttagaaagaaattaatattttaagccaacatttcctttttcgatatatgtgccactagatgagaaaaaaaa

SEQ ID NO: 2251 - DNA, 605 bp, Homo sapiens
taaagaacaacaatctttaggtcatgcagacctccctgatggcatccagaagtttcaccgaggggtgcagacagtgttgatcattggggatgtcacctcccggatacccacctcactcatgaaagcccccagttatgtgagagttcaagtcagtcggttgtgagagttcaggtctcccgccttcttgctttggccaaattgaatgtatctttctctgctcctaagcgctgatgtgtcaatgtttgccttactgtgaatcgggtacacggacctaaatactggggttctacaatgctgagacctgccgccacctgcttcttaaagcaggttgatccagcactgtattaggggttatggcaacattattgaattttttatgtacataaagccatatgtttagggtggtttctgtcttgtttttgacttatataacactgtgaacttctaaagagagagaataaaagaagcatgaatgaaaagaatggcacttcaaaaaagatggttcagtgaaaaactatagctaaaatatgtaaacctttctaagtaaaccgcttgccttcatcttgagttggaatatatttaaataaattgtgttatctcttggc

SEQ ID NO: 2252 - DNA, 349 bp, Homo sapiens
gcaattacactccagcctgggtgacaaaagcaaaactctgtctcaaaaaatgaataacatctgtagtactctatactacataacttataaaagcatcatttcactatgtttcagaataagacatggaatgggagtaggagaagcaaatttgattcatgaatgtttaataattgcacttaaataatttttaatatagtatcaaatatttaacatacaagcagcataaagaataatataataggggaggctgaggtgggagtatcactcgagcccaggagatggaggctgcagttagtcatgatcgtgccactgcactctagcctgggtgacagcgagaccttgtctcaaa

SEQ ID NO: 2253 - DNA, 338 bp, Homo sapiens
cacttgataaggaccgtaagcttcacttgggaccatgtggggttctgtcttaggttctgtctctaagaggccacttggaatcacatgaccagctttagtgacaccacctagcataagctgctcagactatgggtatgtttgcacccaaataaaccacaaatgcctcctgaggtgggagtgtgtgttgcaatattcacaaggtgaatattcacaatgccctgctctgggcactctcagagctggcactccataaacacctcctgtccaattaatgaactcactgaatatccaccagggacccaggcatgcccccaaggactctgatttggctcttcatc

SEQ ID NO: 2254 - DNA, 359 bp, Homo sapiens
tatacttttttttttctttgtagagggggtgttgctgttgcacagactggtcttgaactcctagcctcaagtgatcatcctgccttggcctcccaaagtactggaattacaggcatgaaccactgagcctggccttacatttatcctttttttaaaaaaaatattttctgaacacttaatagtcattatagcacagtgattaagagtatggactctgaactggacttttgggcccaagtctgttctgcaccacttattactgtgtgagtctgagcaagtgacttattatctacttacctccattttgtcacatgaggataaaaaaattcttttcttatagggttgttgtgaagaataca

SEQ ID NO: 2255 - DNA, 174 bp, Homo sapiens
aaaggtcctggatgccactagaacctttagttaggactgagatgtatatgcaagagtggcacatatcaaaatatctgctcattggttcagatccaacgtaagttttccttgaaccagaacctcatattaacttacagtactcaatggcacagcatcctctaatttaaagatttt

SEQ ID NO: 2256 - DNA, 459 bp, Homo sapiens
actttttttgtctgctagagttatttatttatttttctgagacagagtctggctctgtcagccaggctggagtgcagtggcgcgatctcggctcactacaacctctgtctcctgggctcaagcaattctcctgcctcagcctcccgagtagctgggattacaggtgtgcgccaccacgcctggctaacttttgtatttttagtagagacgggttttcaccatgttggccaggctggtctcaaactcctgaccttgggtaattgcccacctcagcctcccaaagtgctgagattacaggcgtgagccactgtgcccagcctagagttattttttaattgagatataatttacatgacagacaacttacccatttgtaaagtataattcaatagtttttcatctatttagtgcaaccaccaccaccatcatcaattttagaacatctcatcacctcaaaaa

SEQ ID NO: 2257 - DNA, 434 bp, Homo sapiens
attcacaattgtaggccatttttagtaaatgctgtactaagaaaggtaggggcctaactcaggtgttggctaaaacaaatagtaaaaatttttgacagctctgagcttttccagacaaaaacccaaaaaggggctagattgtcccagggacactgacttaggctgccagaagccatgttaaagtttggtcaagtcccgtagtgcaggggtttgaatggagtgtttgtgccaagagttttatgcagtcctcagttcccaaatgaggaatcccacctcctcaatgcagaagtcagaactcacatctccatactcccttgtaggtaggatgcaggcatttggccaggttttctctatattcctggaaaaggataccaggctcagggaaaatgatctttaggaaggcctggtggtgaagatataggtatgtgggggca

SEQ ID NO: 2258 - DNA, 490 bp, Homo sapiens
actcactgaatcttgttaactgatatccttgatgtattcttggtatattctaactatatgcatggtatattcatggcatattatgtcttgggaatattatacctgaaaattttttgttcatccatttttttataaattagatgtaatatatacttttctttaaaaatacagttatcattatttttatagatatataaaaaatagcccgtgcgtagtggctcacgcctgtaatcccagcactttgggaggccaaggcgggcggatcacgaggtcaggagatcgagaccatcctggctaacacggtgaaaccccgtctctactaaaaatgcaaaaaaaaaattagccgggcgcagcggtgggcgcttgtagtcccagctactcgggaggctgaggcaggagaatggcgtgaacccgggaggtggagcttgcagtgagccgagatcgcgccactgcactccagcctgggcggcagagcgagactccgtctcaa

SEQ ID NO: 2259 - DNA, 235 bp, Homo sapiens
ttttttaaataattgacttttaaaacttctttttacacaggtcacaacatcaacttcaaaagacaagagcttgattccatactctaatactgtgtcatctaaactctgtggtaatatgtttgtttgtggtgacaaatgaaagcacccaacacccatacctaaaatcactacaaagtacataaatgcctttgacaattttatatagcctactgatatataaagcattccaggtata

SEQ ID NO: 2260 - DNA, 1422 bp, Homo sapiens
caagggcaaggaacgtttgttttctacctcagtattgctgacatcagcccaactcctggcacagagttgcagaataaaacaggaggcatcatggttacttccattcagacagccacaagccccaacaccaaagggacttggtcctaaaattcacatcctcctgccccactgacccctgccaggccttggtggaagttctgtccacagagtgcacacgtgggtgtctgaatctttgtgtatcatccagctccctttcttgcccagcaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgacaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctccagccctcagagcgtccggagcagcaggatacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccacaatgacatgaaataaatttaataagtctagatcagcaaaaaaaaaaa

SEQ ID NO: 2261 - DNA, 2380 bp, Homo sapiens
tcgccgtggctttcgggtgctaggagacagttgccggcgttgggttgtgcgagacgctaactgtaccctccgggtttaacgctgtgaggcagcgcgcggaggaactggggataagcgccccggagcccccaaacagagcgcggccgctgggggacagcgcgcggcgccgggtcggggcggggcggcttttctgtcggaggacgcgaaccggcacgctgcgcctttaaggagtccggctgggctgggcgccggagctgggagccgcgcgggtaggagcccggcggcaggtcccagcccggggctagagaccgagggccggggtccgggcccggcggcgggacccaggcggttgaggctggtcaggagtcagccagcctgaaagagcaggatggatcttgatgtggttaacatgtttgtgattgcgggcggcacgctggccatcccaatcctggcatttgtggcttcatttcttctgtggccttcagcactgataagaatctattattggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccagtttgtagaatgcctgaagctgaacaaaaaacctttccacctggtaggcacctccatgggtggccaggtggctggggtgtatgctgcttactacccatcggatgtctccagcctgtgtctcgtgtgtcctgctggcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgacaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctccagccctcagagcgtccggagcagcaggatacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccacaatgacatgaaataaatttaataagtctagatcagcaaaaaaaaaaa

SEQ ID NO: 2262 - DNA, 2445 bp, Homo sapiens
tcgccgtggctttcgggtgctaggagacagttgccggcgttgggttgtgcgagacgctaactgtaccctccgggtttaacgctgtgaggcagcgcgcggaggaactggggataagcgccccggagcccccaaacagagcgcggccgctgggggacagcgcgcggcgccgggtcggggcggggcggcttttctgtcggaggacgcgaaccggcacgctgcgcctttaaggagtccggctgggctgggcgccggagctgggagccgcgcgggtaggagcccggcggcaggtcccagcccggggctagagaccgagggccggggtccgggcccggcggcgggacccaggcggttgaggctggtcagaatctcattttcagcttctgccagagccagtagcagttgggaaagaaggctgtgctctttgaagagagtcagccagcctgaaagagcaggatggatcttgatgtggttaacatgtttgtgattgcgggcggcacgctggccatcccaatcctggcatttgtggcttcatttcttctgtggccttcagcactgataagaatctattattggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccagtttgtagaatgcctgaagctgaacaaaaaacctttccacctggtaggcacctccatgggtggccaggtggctggggtgtatgctgcttactacccatcggatgtctccagcctgtgtctcgtgtgtcctgctggcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgacaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctccagccctcagagcgtccggagcagcaggatacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccacaatgacatgaaataaatttaataagtctagatcagcaaaaaaaaaaa

SEQ ID NO: 2263 - DNA, 2193 bp, Homo sapiens
ggcgctgcccccacctcccgctgcctggataggtttgagatgcccgaaacccggcgccccatttcctgggtccagccagcctcttgaagccgggggacagagtgaggacggaatctcattttcagcttctgccagagccagtagcagttgggaaagaaggctgtgctctttgaagagagtcagccagcctgaaagagcaggatggatcttgatgtggttaacatgtttgtgattgcgggcggcacgctggccatcccaatcctggcatttgtggcttcatttcttctgtggccttcagcactgataagaatctattattggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccagtttgtagaatgcctgaagctgaacaaaaaacctttccacctggtaggcacctccatgggtggccaggtggctggggtgtatgctgcttactacccatcggatgtctccagcctgtgtctcgtgtgtcctgctggcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgacaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctccagccctcagagcgtccggagcagcaggatacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccacaatgacatgaaataaatttaataagtctagatcagcaaaaaaaaaaa

SEQ ID NO: 2264 - DNA, 2240 bp, Homo sapiens
ttccctttccccagcctgccccggctcccgtgcccttgcgccccttccgtgtcgaaacacttgaatcaggatgctgtccagccaggtacccgccggcaacttgcggtcccccgcctacagcgacacaggtttcacggctgccttagaaatgcggattgtgtaacgccggctgcagggcagtgcacgtgcagggtttgcgcccctgagcccacagcgaggccaggagtcagccagcctgaaagagcaggatggatcttgatgtggttaacatgtttgtgattgcgggcggcacgctggccatcccaatcctggcatttgtggcttcatttcttctgtggccttcagcactgataagaatctattattggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccagtttgtagaatgcctgaagctgaacaaaaaacctttccacctggtaggcacctccatgggtggccaggtggctggggtgtatgctgcttactacccatcggatgtctccagcctgtgtctcgtgtgtcctgctggcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgacaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctccagccctcagagcgtccggagcagcaggatacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccacaatgacatgaaataaatttaataagtctagatcagcaaaaaaaaaaa

SEQ ID NO: 2265 - DNA, 2236 bp, Homo sapiens
tcgccgtggctttcgggtgctaggagacagttgccggcgttgggttgtgcgagacgctaactgtaccctccgggtttaacgctgtgaggcagcgcgcggaggaactggggataagcgccccggagcccccaaacagagcgcggccgctgggggacagcgcgcggcgccgggtcggggcggggcggcttttctgtcggaggacgcgaaccggcacgctgcgcctttaaggagtccggctgggctgggcgccggagctgggagccgcgcgggtaggagcccggcggcaggtcccagcccggggctagagaccgagggccggggtccgggcccggcggcgggacccaggcggttgaggctggtcaggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccagtttgtagaatgcctgaagctgaacaaaaaacctttccacctggtaggcacctccatgggtggccaggtggctggggtgtatgctgcttactacccatcggatgtctccagcctgtgtctcgtgtgtcctgctggcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgacaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctccagccctcagagcgtccggagcagcaggatacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccacaatgacatgaaataaatttaataagtctagatcagcaaaaaaaaaaa

SEQ ID NO: 2266 - DNA, 2379 bp, Homo sapiens
tcgccgtggctttcgggtgctaggagacagttgccggcgttgggttgtgcgagacgctaactgtaccctccgggtttaacgctgtgaggcagcgcgcggaggaactggggataagcgccccggagcccccaaacagagcgcggccgctgggggacagcgcgcggcgccgggtcggggcggggcggcttttctgtcggaggacgcgaaccggcacgctgcgcctttaaggagtccggctgggctgggcgccggagctgggagccgcgcgggtaggagcccggcggcaggtcccagcccggggctagagaccgagggccggggtccgggcccggcggcgggacccaggcggttgaggctggtcagaatctcattttcagcttctgccagagccagtagcagttgggaaagaaggctgtgctctttgaagagagtcagccagcctgaaagagcaggatggatcttgatgtggttaacatgtttgtgattgcgggcggcacgctggccatcccaatcctggcatttgtggcttcatttcttctgtggccttcagcactgataagaatctattattggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccaggtggctggggtgtatgctgcttactacccatcggatgtctccagcctgtgtctcgtgtgtcctgctggcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgacaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctccagccctcagagcgtccggagcagcaggatacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccacaatgacatgaaataaatttaataagtctagatcagcaaaaaaaaaaa

SEQ ID NO: 2267 - DNA, 1514 bp, Homo sapiens
gttagttttaccctactgatgatgtgttgttgccatggtaatcctgcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgacaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctccagccctcagagcgtccggagcagcaggatacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccacaatgacatgaaataaatttaataagtctagatcagcaaaaaaaaaaa

SEQ ID NO: 2268 - DNA, 2366 bp, Homo sapiens
tcgccgtggctttcgggtgctaggagacagttgccggcgttgggttgtgcgagacgctaactgtaccctccgggtttaacgctgtgaggcagcgcgcggaggaactggggataagcgccccggagcccccaaacagagcgcggccgctgggggacagcgcgcggcgccgggtcggggcggggcggcttttctgtcggaggacgcgaaccggcacgctgcgcctttaaggagtccggctgggctgggcgccggagctgggagccgcgcgggtaggagcccggcggcaggtcccagcccggggctagagaccgagggccggggtccgggcccggcggcgggacccaggcggttgaggctggtcaggagtcagccagcctgaaagagcaggatggatcttgatgtggttaacatgtttgtgattgcgggcggcacgctggccatcccaatcctggcatttgtggcttcatttcttctgtggccttcagcactgataagaatctattattggtactggcggaggacattgggcatgcaagtccgctatgttcaccatgaagactatcagttctgttattccttccggggcaggcctgggcacaaaccctccatcctcatgctccacggattctctgcccacaaggatatgtggctcagtgtggtcaagttccttccaaagaacctgcacttggtctgcgtggacatgccaggacatgagggcaccacccgctcctccctggatgacctgtccatagatgggcaagttaagaggatacaccagtttgtagaatgcctgaagctgaacaaaaaacctttccacctggtaggcacctccatgggtggccaggtggctggggtgtatgctgcttactacccatcggatgtctccagcctgtgtctcgtgtgtcctgctggcctgcagtactcaactgacaatcaatttgtacaacggctcaaagaactgcagggctctgccgccgtggagaagattcccttgatcccgtctaccccagaagagatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgacaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctccagccctcagagcgtccggagcagcaggatacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccgatatcgtgggtaccagctcggttcgtatcatgta

SEQ ID NO: 2269 - DNA, 1430 bp, Homo sapiens
gctcctatgtccgcttcaaggtgcagagctgaagcatttcactcatctcttctggggtagacgggatgagtgaaatgcttcagctctgctcctatgtccgcttcaaggtgccccagcagatcctgcaaggccttgtcgatgtccgcatccctcataacaacttctaccgaaagttgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagcttctggaaaactgtgggcactcagtagtgatggaaagacccaggaagacagccaagctcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgacaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctccagccctcagagcgtccggagcagcaggatacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccacaatgacatgaaataaatttaataagtctagatcagcaaaaaaaaaaa

SEQ ID NO: 2270 - DNA, 1357 bp, Homo sapiens
ggcttttatttcttaaatctctgacactttgaatgtctctttgggcccctgaagagaggaagtggtggcctggatctggtgactatcccttgattctgcggtggtgccacaggcacagtccagcacatactcactttgttttccttttctgacaagtgtttttggaaatcgtcagtgagaagtccagatactctctccatcagaacatggacaagatcaaggttccgacgcagatcatctgggggaaacaagaccaggtgctggatgtgtctggggcagacatgttggccaagtcaattgccaactgccaggtggagctttcataatcgactttttagcttctgtgcacaacacagacaacaacaagaagctggactgaggccccgactgcagcctgcattctgcacacagcatctgctcccatcccccaagtctgacgcagccaccactctcagggatcctgccccaaatgcggtcggagcgccagtgaccctgaggaagcccgtcccttatccctggtatccacggttccccagagctttggggaccacgcgaaaacctccaagatatttttcacaaaatagaaactcatatggaacaaaataagaaaccccagccatgaaatctaccatgaagtcttcaagttcatgtcactgacaagcttgtgcaaagcagccaccttggaccataattaaatcaaggacattttctttgagacattccttatagttggagactcaagatatttttgttgcatcaggtgtattcccttgcatgggcagtggcttttataggagcattagtcctcattcgctgaaccctgttgtttaggtctaatttaagttttacatagagacccatgtatgactgcagcccattggctgcaagaccagggaggaaagtggcaagctgtagaaaatgtttacacgcatggaggggcattgctccagccctcagagcgtccggagcagcaggatacatgggtgggaggttcattcagcacccaccagtcaggtatgttctgagtgaacccacagcagtcgcagaatgagcacctggcagggtgggtttcctaggaataatttattatttttaaaaataggcctaataaagcaataatgttctagacatctgtctaagtaatcagactcaggttccacacacaagcaacaactcgtgggcctcttttctatttcaatgtgctactaagaacccttggatgtaacatactagttagttaatgaattctgtgaattctgtgaagagtaatgtgattgaaaataagtctaaacagctgtaaaagtgaccacaatgacatgaaataaatttaataagtctagatcagcaaaaaaaaaaa

SEQ ID NO: 2271 - DNA, 570 bp, Homo sapiens
tgaagactatcagttctgttattccttccggggcaggcctgggcacaaaccctccatcctcatgctccacggattctctgcccacaaggatatgtggctcagtgtggtcaaggtgcaattctcgattcttctctcttataagaaaagggagttgggtgctgtggctcatgcctataatcccagcactttgggagcctgaggcaggaggattgcttgagtccaggagttcaaaaccagcctggacaacataaagaaaccctgtctctacaaaaaattaaaaaattagccaggtgtggtggtgcatgcctgtagtcctggctactcaggagactgaggtgggaagattgcttgagcctggggggtcaagtcttcagtgagcaatgatcatgccactgcacttagcctgggcaacagaataagactctgtctcaaaaaaaataaaaataaaaaaaggaagaagaagaaaagggtttccactaggacatgatgtcatcaacaatggtagaaagcaaagggaactcagaactgtggtggttcaagtcatattagaactaatgcagtgtggcctgg

SEQ ID NO: 2272 - DNA, 333 bp, Homo sapiens
ttgttttctatggtcttcggaataaaggagataagagattttgttgaatgtacagagaaataaagtccccttttaaagtcccttttttacttgtcagatcactttatctggtatttctttagcgccagtatagaaggcactaccgtagatggtagaattatcagtaatttttaatggcagagaagcagccagtgataatagggagaaatttggaggctcaggaggcaccagtaggtgaacaaatttgccttttttttttttacttataatgtctatccttttatgaaaataagaattgtgctttagttaaatagaattcaattatatttttcc

SEQ ID NO: 2273 - DNA, 1415 bp, Homo sapiens
ccaagaataaactagtaaaagaaacttagatttccctaatttaatcttgactccgattttgatagtgctatataaaaaggtatttaaacccatatgcttccttttacataaaagaaagatatcaactttcctagtttgcatttacactggctaataggataataaaatgctgtgtaaatgttaaactggaagtttctctgagttatttttactttaaaatttcatgtgattatgccattttgaatatgtatattacatgtaattgtataatgttaacttgggtaggcaaaattcttggtattaaatttaggatgttttaaaaattattaagaagatattaatgtctgctttttgatagcatattttcatgtaatgtttagtgtattaaaatcaaccattcaagatttattttattgggtgacactattgactgtgttccaaaatgcccatagtgttaggaaatgtggtgtgagttttatttgtgggctaaggataaaataatcatatgctaatataccttttattataaatgactaaaaatttggatataaaactgatgttttactacacaaattacagagagagataatataattatataattattaaataattagaaaatgcaaataagcaaaagtcacccatgttcccagttctcatctcctgaagatagttataactaacatattattttgtactcttcctgttaattagtttctagtgtactttctcctgtagctgaaattaagctgagaaaaaaggaagagatagttcctccctcctctttcttctctcccactctgtctctctcctgtgctatctgtgtgtatatacaaatatgtatgcatatatatataatgatgtacataatatatataaaatacaaatactaatgtgcatattttcaaacatacacatattttttattatttgaaataagaatgagtcagactacatatttggtagccagatttttttcactcagtgatatatcatgaacatatttccatgctaatataattttctaataattttagatgctgtaactacaatttcattgttaatgggcaatttgttgctttacaaatggtaaattatatgataaataatatgatcattattcttgtagccaatatcattattagaaatgatggaccgcattaaagctataaaattaaataagaatttataaatgtaaggagttattcagacatcttgtatctagtattacaatatcagaaaactcagcaggttatatgacatatacactttgagatagtcactcagaggttttcacatacaggattaaccttgctgcagtgcgtgtgcaagattaaaaaagatgtcatgggtcactttgtaatgtcatatcgttgctgttgataaataaaggaaatgttataaataaaaaaaga

SEQ ID NO: 2274 - DNA, 2097 bp, Homo sapiens
gagatgaagtctcgctctgttgcccaggctggagagtgcagtggtacggtctcagctcactgcaacctccacctcccaggttcaagcgattctccagcctgagcctcctgagtagctgggattacaggtgcctaccaccacgcccaggtaattttttttttttttgtatttttagtagagacggggtttcaccatgttggccaggctggtctcgaactcctgacctcatgatccgcccgtgttggcctcccaaagtgtgggattacaggcgtaagccacctcacctggcggtacaaagaatttctgcattttcttccctggcccctagtcctgcaccgatttctccttttcgaatgtattcctcctgccaccttctctgggcaacttcgtgcgactacagaaccactgtcctgaggagctagaggcctcctctctgaccatccagagcccaaatccacagcttccccaaatttcatcagctgccacttgacgacttctccccgtctctctgaggcccggaaaccacggctggaggtggggaggggatggcggctgaggtccattcctcattctcagacctcattgctcagttgcactatttggggcacagaataatcaccaaaagtgagaaaaacgagtttgggtggctggggaggactttgggactcttgatgcaaggcgcaacttgagaaaattctgggtgtgatatttgcacagacaccctcctttcaaaaacagccaccccccaagctattctcagctccacacctgcagccccagctaaggtaccaggtctcctgagcaaggcagagagaagccttgagccttctctgtgtcttctttcaagaaccccgctgtgtcttctttcaagattttttttttgagacagtttcaagattttggttttgtttttgagatggagtctcactgtgtcacccaggctgaggtggcagtggttcaatctccgttcactgccacctccacctcccgggttcaagcgattctcctgcttcagcctctcgagtagctgggactacaggcacctgccaccatgtctggctaatttttgtatttttagtagagacagggtttcactacgttggccaggctggtctcaaactcctgacctcaagtgatccgcccgcctcggcctccccaattgctgggattacaggcgtgagccactgtgcccggccttcttctttcaagttatatagaatggagcatgggggtggcagtggctagggacatttcctggggacactctcccctaaccccccagaaggacttcacaaaaacctgtggataatggaagggatgttacggtacaaacgtatatttatgtgtgtgtgtgtgtatgtgtgtgcgcgcgcgcgtgtgcacataggcgtgatgtctgtgaccctcctctcctcgtcacatttcccccagaatgaatgctgtcctgtctgctcatgtttgtgttgaagctgccaaagtcggggagctctggtcctgcccagacccctttggaattgctggcccatcctcccactggagagctggggtgcagctcaccttggggaaggaaacctcatgcctcagagtaatttcttgtgaatgcaaagcctgggggagcgggtctttggggggcaaggagccagtcaggggcttgtttcccctcatagagctccccagacgtgcctccgcaatgcctgaaacccagacctaggctaataaacggttcaatttctgtaaaaaaaaaaaaacaaaaaacaaacaaatcacacaacaagagaacaaacccaaagacagccaacacaaacacaagacaacgcgcacgaaaaacaccgaacacaaccagcagaacacaaaaacacagatcggcgcgggcagaaacgctcaccgaggacggcccacacctgttcaacgagccccgcctatgcagacagcaggagggcgcccactcagagagaggcggccacaaaacaaacgaagcggagaaggggcggcagcaaagacaccgcacgagcgcgggagaaaaaccacagcgggaggagaagtacggagagagacaaccccgcggggcgggagcaaacgaggaacgcagacacacga

SEQ ID NO: 2275 - DNA, 1162 bp, Homo sapiens
gagatgaagtctcgctctgttgcccaggctggagagtgcagtggtacggtctcagctcactgcaacctccacctcccaggttcaagcgattctccagcctgagcctcctgagtagctgggattacaggtgcctaccaccacgcccaggtaattttttttttttttgtatttttagtagagacggggtttcaccatgttggccaggctggtctcgaactcctgacctcatgatccgcccgtgttggcctcccaaagtgtgggattacaggcgtaagccacctcacctggcggtacaaagaatttctgcattttcttccctggcccctagtcctgcaccgatttctccttttcgaatgtattcctcctgccaccttctctgggcaacttcgtgcgactacagaaccactgtcctgaggagctagaggcctcctctctgaccatccagagcccaaatccacagcttccccaaatttcatcagctgccacttgacgacttctccccgtctctctgaggcccggaaaccacggctggagctgccaaagtcggggagctctggtcctgcccagacccctttggaattgctggcccatcctcccactggagagctggggtgcagctcaccttggggaaggaaacctcatgcctcagagtaatttcttgtgaatgcaaagcctgggggagcgggtctttggggggcaaggagccagtcaggggcttgtttcccctcatagagctccccagacgtgcctccgcaatgcctgaaacccagacctaggctaataaacggttcaatttctgtaaaaaaaaaaaaacaaaaaacaaacaaatcacacaacaagagaacaaacccaaagacagccaacacaaacacaagacaacgcgcacgaaaaacaccgaacacaaccagcagaacacaaaaacacagatcggcgcgggcagaaacgctcaccgaggacggcccacacctgttcaacgagccccgcctatgcagacagcaggagggcgcccactcagagagaggcggccacaaaacaaacgaagcggagaaggggcggcagcaaagacaccgcacgagcgcgggagaaaaaccacagcgggaggagaagtacggagagagacaaccccgcggggcgggagcaaacgaggaacgcagacacacga

SEQ ID NO: 2276 - DNA, 448 bp, Homo sapiens
cgaagggcagtcaccttgaaaatgagcaaggaaaaagccttgaggcagcaccctcccctccaaagagcttctcgccaagcatgtcttcctgggggctgggaaatggcatgcggcctcctctactctccttcttatatgccagacccctgtcctttcagcggtccatggagtaaggaccacaaatcggcctccacatccacagcctgcctgggaagggaaaggtctgaggtgcactaggctggacacactggcaccgcctatggtcccagctactcaggaggccgagacaggaggatggcttgagcccaggagctcgaagctgcaaagagccatgacggcacctgtgagtggtcacacaggggccaccgagaacttgcgaggggcgttcagaggcagcactgcagaaccgcagacgcctagccagccaggtccaggacagctgtggcgg

SEQ ID NO: 2277 - DNA, 144 bp, Homo sapiens
atcctgcatttctgctatcttcacctcctttgtttccgattcttccctcatttctacatcccccaaatctcagcaccaccacccccagtttcccatcctccaaattttccaggctgtagcccacttgccttctcatgaccccaa

SEQ ID NO: 2278 - DNA, 239 bp, Homo sapiens
gaaatgtaatgtagtctattttactttgaaaggattcctttatttactttgaaaggattcctttttcaagaaatagctttggagaaaacaaacaaagaaaataaccaaaataaactgtccctaactccttttccttgagtattgaattttctgaaggaaaccctccctgaagaatgtttatatatatatatatatatatatatatatatatatatatatatatatatatatatatatat

SEQ ID NO: 2279 - DNA, 175 bp, Homo sapiens
gcatcacttggtggtgactgtggacgaggccatctttttaaggctgtgctattttatatgatcctcatgttcccagtgagccacattttagaaagctgaggcacaaagaagtttagtgattttgccaagccaccacagtagtgaatagtccagcagggccttgtgctccaggggt

SEQ ID NO: 2280 - DNA, 460 bp, Homo sapiens
atttcccggcatacagcaagcacttaatagatgtttaagtgaatgcatgattgacaatttttctgagattgttttcacagacgtaacagcagttaccaccccacatgctctcctgaggattgagtgggattatgggtatcagagctctctgtaaatgtaatagtgctggttgatgatgcctggaagtgaatgtggtctgggagacagggagagggctctgccatacaagagcctctgcccaggccaggcatctcttctgtcagactgagtcccaggccctggggtagtgctctgattccagctctccttctcagctctctatctcaccctcggtccaacctcctcaccatggctcagctctaggtattgcttttctccttcagccagtcaggacaggacccaggagacttaccattggccaagcctcttgcctgcaggccactctacctcttgtgctggc

SEQ ID NO: 2281 - DNA, 1451 bp, Homo sapiens
  misc_feature (447)..(447): n is a, c, g, or t
cccctcctgccacctcccagggctctggataattgaatcttcctgagtcccacagctggagactcaaccaggatatagctgtaaatgcccaagtagaatctgacagaataagacagagacactgaaaataaagccctagaaaggaagaaattggaagcaaagaaaaggagaggtgaaaagataaaaagcctccttcaaggttaggttcaggttctgttttccatttaacctcatgtgccataaagctgcccaggcacaccagagccacatcctgaacccgaccctccctgacagtgctgctctgccagtagcaagccccagatggaggaagctgggcccatttctggccacttccacccatttggagctttgccagaggagtcgtctatgccaataatatttctgcaacagcatattatattatttgaagattagtagatctttttngggggggtggggcaggggacagtttctatagatgaagaaccagtgttggttgtacagctgttgggggtcatctatcccatgtgaagctattctttttccaaatcttgttgtttctgcatttgtgtcctccaccactcccttcttggctgacatagatatgcctgccagattgtcatcaagggtcatatttcaataaaaggtgctaaggacaaaaaaaaatctcatgtgttttaactcaggtgatggaagtctaaagattctgctgaaaagtactggaaaggaatttggtcacctatccatagtccttcacagataaacatatgaccagacccttacccacatccctaaacccttaccctggcctctgagggatggtattgatgctataccattcatcatccccagttaaatagcaggatctgccatagcctttttaggggaacagcttttagacatctatttcaagaccatcctgagtagggggtacagagtttaagccattggttatttctgtagttatcacagtattgaagcatggtatttttctactcagaaggatctcaggatcacagccctgccctttagctcactgatatatttcttcctctctggttactcagtggcaacatcacatccagtctaaccccatgtttagaatgcagaaaaagtcaacaataggtgtaatctcaggtatagacctaagcagtatacagagtctagttctggagtctagcctgatcgaaggtaagccattctttctagacttcttccaatcttgaattctgtctagtattttcatcttacttctagctgatagtccaatctcacaccttcatgctcagctccctggaaagcaagggccttggtgatctgctctccaaggcaacctcaaagattagactcaaatgtattccaggaagcaactctgacattgaaaagctttcttttttcgtgatccatattctgttcacattccaactatcctccttctactcaagatatcc

SEQ ID NO: 2282 - DNA, 472 bp, Homo sapiens
tcgtgccaaggcctggactactttttaataattaaatataaatcatgatcaccaaaacaaaacattctaataactaaaatcacagagaacaatgagatttttctgatttttcacagggctgggaagaaaaatccatcagagtaagagatggcagtggttggaaaaagtaaagacattctctacttgtaccctctgtggagttcagactttccataaatcaggcactgtgtcaatgaggatacccaggagatgaatggaatctactgtctttcccacgcttgtcaaggcatctcatctgagcagttaccaacatcagcacagtggggctggtctgccccatctccatctgacccgcccagcttgcccagtgatgcatcacaccgcaatagtgggacattttttttctaacaatggttctactcccctggtgtaaaagcaaataaacgggaatggggtataacttgatactaaa

SEQ ID NO: 2283 - DNA, 441 bp, Homo sapiens
gtttgtttttgagatggagtttcgctcttgttgcccaggctggagtgcaatgacgtgatcttggcttaccgcaccctctgtctccccggttcaagcgatcctcctgcctcaccctcctgactatctgggattacaggcatgcgccacaatgcccagataattttatacttttagtaaagacatttcttcatgttgggcagcctggtctaaaattactagaaaaataaaagtaatctattatagtaatttatttaagtgattcttatatttaaaataccagcagttaaatatgcctaggaaaatctaaataatgacccattggtattggaaggaaattggggaaatgtttaacctaaagggatgacttcctaaaattcagtagaatttcagtcactgcgatacctgggaagggaaggtaatttttttgggaggtgcatgcag

SEQ ID NO: 2284 - DNA, 648 bp, Homo sapiens
tttttaaaaaaactaataaaacatcaatagagaccttccaataaatgcctgagttgtttttgtttcgtttcgcttttgagacatagcttcactctgtggcccaggctggagtgcagtggtgtgatctcagctcactgcaacctacacctctgggttccaccaatcctcatgccttggcctcccaagtagctgcgtgtgccaccacacccagctaatttttgtattattagtagagatggggtttcaccatgttggccaggctggtctcgaactcctgacctcaaggtgatctacctgcctcaagcctcccaaaagttctgggattacaggcatgagccaccgtgcccagacaagcacccaaggttttcccacacatagagcatatgcctaggagcagaggaatagactaaatgatctattatcctgtatcctgtaagaaacagacccaactacccatgtgctccaaagccatactccataaccatcttgggcactgcaccctggaacgctgcacacacagaactcccttcagttcccaccaactgtgggacctctacccctcatcgggccatcttcatgcactgcttccaactgtgatttatccatctgtgtgtacatctgggccccattcaattttaacttaaattc

SEQ ID NO: 2285 - DNA, 403 bp, Homo sapiens
ggggaaaccccgtctctactaaaaatacaaaaaaattagccgggtgtggtggtgggcgcctgtaatcccagctactagggaggctgaggcaggagaatcgcttgagccggggaggcagaggttgcggtgagccgagatcatgccattgcactccagcctgggcaacaagagaaaaactctgtctcaaattaaaaaaaaaaaaaaaaaaaagagagagaaaagtcaaactcatcaaagacaattgggaacaaagaaggaagctaacacttaatgtgctcccactatgcaccacaaatcctgtaaagtgggacttacaaattcccatttgacagatgaggaaatggaggtttagagctgttaaatgtcttgcccaaaggccacccagctgttaagataagaaagc

SEQ ID NO: 2286 - DNA, 398 bp, Homo sapiens
taccagaagagcctcggggaaacgcggcgtggattcgcaggccttggcggggctccgaagcagtgaagggtctaggtataaggcggacacccaggctaggcctgaaagcagaggggtgaggaggacgaaggtgcgagtgtgtgggggttgtctcttgtggggagccagcgggaagccaagcaccctaagagtaggactccagatccttttgttcaccagactccccagattctagggaggctggggaccacgggctgagccccctcctggcttcagtgctgaaggagaaggcagagaggcaacggggagagagacagagacagtgacacacagcttagaggaaaggaggggagaggatgagaggacagagagagagaggagaagggagacaggaaagc

SEQ ID NO: 2287 - DNA, 587 bp, Homo sapiens
caggctcacctccctttggcttcactctctttgctcctcagcttcagagcactgcatcctcaaaggccaagatgaggatgctaaattaggaaaaaaggctgtggagtctgaattttagttcctatcttgggctagaggggtcaaagaattcctgaagcttatgtaagggccggctggtcagctccctagaaccacgggctccacagaggtggcaaaacccagtgattttgccagtatccctgcagggacctgcggtacaggcaggttgaagatctgagactcaggaaccttggcccctttgtcacttacaactgtgtgtgaaacaggactaacagtttggactgagagcactgaagctgctgtgtgttgtgcatataacttaatgctgtgtgttgtggcttgcactgctgtgggggcggggagggcagtggtggggaatggctggcatgaagcttgcttgagccaatgctatgcttgctgggctttggctgactggctttgggccaccaactgtatttgcatagtgatggcttggaagtgtccatagaagggattgcaataaaggtgtgtcttccttctgctcggga

SEQ ID NO: 2288 - DNA, 457 bp, Homo sapiens
aggcgggcggatagcttaagcccgggagtttgagcctgggcaacatggtgaaaccccttgcctaccccaagaaaacacaaaaattagccaggtgtggtggcataagcctggagtcccagctactcaggaggctaaggtgggaggactgcttgaacctgggaggcagaggttgcagtaggccaagatcatgccactgcactccagcctgggcaacagagtgagagcctgtctttgaaaaaaaaaaaaaaaaaaaaaagcaaaaaatgaggccaggtatataaataattgtaattcttcattggagttgttcagattatcttcgggtggcagaagaaggagtcgtggaatttttatatttatcagaaggtgaaatgggttacaaatcagtgtggaagctcagacccagctcaacctttgggtttgggcaggtgcaggaacagggctggtattgagggga

SEQ ID NO: 2289 - DNA, 423 bp, Homo sapiens
tagctgggactacaggcgcacaccattatgctcagctaattttttgtagagacacggtttcactttgttgcccaggctgatcttgaactcctgggctcaagtgatcctcctgcctcagcctcccaagcagctaggattacaggcgtgagccactgcgtccagccataggggtaaatcttgactgggcgaagtcttagactctaagccagtcatggttatatcagtccccttgccagggattgtttaagagtgaggatgtgatccatttctagtccatgaaatatgagaagtatatgagagggaggggtcgcttctgggtaggttttttttgtggttttgtttttttttttttttttgagacggagtctctcactctatcacccaggctggagtgcagtggcgctatctgggctcaccacaacc

SEQ ID NO: 2290 - DNA, 669 bp, Homo sapiens
tcatatttagttaactaaaacccaaaaatttggtacgtaaaacataatgcatattcctagagtgccaatggcggtatttttctgtattgtcatatccctaaagtcatattttgtactttattgatccaagggcacacttttcctcccatgtttaacatgtctaacacagggctacatcttaaaactaatgttgtcttgcagttatattggcagctttttccccttagtggtacataatctaatgttgaatcttaaaaatattgatatctcaaattcagtgaaatgggaatatttgggggaaaaatctttaaacaatacaaaaccatagactgtaaaaaataagtcttccttgatgacatcctaatctgctgtcctccccactggtagccattcttaacaattcagtggatatccatttctatgcattgacaaacaggaatatttagaaaaatgtacttacaagcaaacgtgtcatatttgtaatctttaaaaatgcacataagatcataataaatattattattctgacttgctttctttacctgaaaatgtactgtggattttttttcatatcaatggattcttcttaataaaaagtgacataattgctgtgcagcgtggtttagccatgatgaatttttcccagtgtggagagaagactatttttca

SEQ ID NO: 2291 - DNA, 283 bp, Homo sapiens
gaactctattgtatgtttactacaattcagtaaaaaaataaataataaagggataaggttttgagaaaaagtgatagatacagacagattgctaagagtattcaacacatacataatagaaatctcaaagaaagaaaacaaaaacagtggaatagaaccaatattaacatcttcacttccctgaaataagatttaaatgatttaaaatttcttattggaaaggcatacatataagaaaaaaaatctacctagaaaagtaaaaatcactggattacaaaaagga

SEQ ID NO: 2292 - DNA, 201 bp, Homo sapiens
gaaactgtgctatatgaatagtgcctaaatatttgtcaatactctagctgtccaggatatgtttctacttataggactcctgatggatgtattacctgatatcagacatcaataatataatattattggtcattttagctgtttattttaatgttatcgtggatgctactttacttctttaatttgaattttgcatcttct

SEQ ID NO: 2293 - DNA, 290 bp, Homo sapiens
tcagaaagaacatggcagagttaggagtcgaacttagacctttctgatgtcaacactgcggcttttatttattggcccaaataaaagtaaagaaccctttattagtatgatagctaactttcaacttgtccatctcaggcgatagaatgcctgaattcagctaaaatatttgcctggttaacaaatgtggtgctctgaagagaacttgaatgagatgcctttcctgtacttcccttttcctgttctatttctttggctctgcagaacatctgatgcaggtcaatggggga

SEQ ID NO: 2294 - DNA, 466 bp, Homo sapiens
gaaaaaattaaaattattaagtaaataattgagtagaaattttgagtaaattgggttgaaaaaatacttgaagtgacaggcaatgtagactttttttgaagagcaatatagacaacataggagttaaaacaaaaacaaaaacaaaaacgatacgcctcaaactatatggggcaatcttcctgcccatgattcctcccgaggtgatatgttaggaatcgtgtgcaaatgatttttgtcatccagttgctacttcttatttattcttctgtagcaagcatccaacattacatctcttatcaagactgatgctcaactggtactcactggtaggctgcagtggttatttatagcctgtgtctgttctgattggtctgattactggctgttgttataactgctgcttttagtgatttatattctctgacaccactgatttaggaagactgtctcgacatctgcctcttcc

SEQ ID NO: 2295 - DNA, 168 bp, Homo sapiens
tagtagagacggggtttcaccgtggtctcgatctcctgacctcgtggctaggtaagaggattttaaaaaaatactccaggtaattctgatgtggggcacatgagcacagccaccaagcattttttccctacacaactgcttttaaatgcagagtagttaccaatcaat

SEQ ID NO: 2296 - DNA, 340 bp, Homo sapiens
ctcaatgatctgtctaacactgtcattggggtgtgttccaatctgtgtgctccaatgttggctgcatatatatttagaatagacatatattgcatatatatttagaatatatttaaaatacattttacttactggtacttcactcacttttattagctggatgccatcatgggggcagtttgcctccattctccttcctgggatctggtgtgtccttcatgattctggtggattcctattcttcttcttaaattaaagctcagagagttgacatttatgcactattgtgctatgtccatgtggctgaagcatgctttaagtctctaatccatcatcttga

SEQ ID NO: 2297 - DNA, 419 bp, Homo sapiens
atagtattagatgtgatagttactgttatcaaagcttagaatcattactctgctaatgatggaaggagagtcagtaaatattaatatctaagctagataaaccatccttgcaaaaattatctagtaatacccagagtaaagtggctcatgcctgtaatcccagcactttgggaggccaaggagggcagatcacttgaggtcaggagtttgagaccagcatggccaacaaggtgaaacctcatctctactaaaagtagaaaaattagccgggcgttgtgacacatgcctgtaatcccacctactcaggaagctggagcaggagaattgctttaacttggaaggtggaggttgcagtgagccaagatcataccactacactccagcctgggccacagaatgagactctgactccaaaaaaa

SEQ ID NO: 2298 - DNA, 405 bp, Homo sapiens
agaattgctcatctggtagcgctccacaacccttacccactttgagcagtgtcacatactaaactttgacataaaatattgctggcagagatgttttggcttttggtattaatgttaatatcaaaaaacccccttaaaacactttcactctaaaagaacttaagctttagacaaactctgctaattcaccattttctcccccacaaactgggaagcctcagttatcttttgatgacttgaaactgatttcaattatttgtgttattgccagcaatataaatgaaaaaaatagtcaggcatggtggcttaggactgttatcctggcactttgggaggctgaggtggcaggatcacttgagtccaggagtttgagaccaacctaggcaacatagcaagaccctgcta

SEQ ID NO: 2299 - DNA, 453 bp, Homo sapiens
gcagaaccaaaaagactaaaaatgtaaaaagatgatgaaggaaagtaaatgttaaaagaaaaaaaatttccgaaaagcagccctggtgccctaacttcagcccctaggtccttaacatggctgcatcaggcaagtttcctaccctaagacccacagctttcaaatattttaaggagcaatttggtggccaaagagagaaagtctcattataaagtggcctttatgtgaggggaccttgcccaagtcatgcccaagacagaggacactgggccatctgtcctcaagtagtttttgctcatgaatccctaagataatttttgaaaaatcatgtttcccctacacatttttaagttgtcacctaaagtttttctcattaattcaaagctgtacaaaataagtttttagcatatttattttaaaataaaagtattacataatcctatgatatctaag

SEQ ID NO: 2300 - DNA, 677 bp, Homo sapiens
catccacttttgagtactgatttgcctcctcctgacttctttttgtttcaaaatctttaaaagtttttaaagggaacccatttgcatcagtaaataatgtaaagaagactgcattgatatggttacatttccaaaacccccagttctttagggatagactaagtggctggtatcatcacttaaaaaagtgtcttgaacttgatggagctcatgttgagaaataaagcttacactttttatttctattttttaattccatttttccgcaaaccctttgaagcccttttgtataactggtaaaatctgtatgagttctgtggattgtaccaatgtcaattacctggttttgatattgtactatagttatataagatgttaacattggaggagactgggccaaagtacacaagacttccctgtatatcttttttgcaaattcttatgaatttacaaatatttcaaaataaaatggtttttaaaatgaaggcaaaacaaggacatcctcagccaaatgaagactaaaagaatttgtagttagcatacttgctttacaagaaataccaagggaagcttaaggaaaatgactccatatggtaacatgaatgcacagcaagagataaagagtactggaaatagtaatcatgcgggcaaaaataaaagactgtatgaacatatat

SEQ ID NO: 2301 - DNA, 415 bp, Homo sapiens
caataggaaattagtgtgtatggcaactccatgctgaagcttctgaggcactgccaaactgttttccaggtggctgctacatgttacatccccaccaccacttggtgtgggcagtccttttgtgtacagccattccagtgactgtgtgtctcactgtggtttgagtttgtatttctctaatgactgatgatgttgaggatcttgccctatggtcattagccatccagatatattctgtggcgaagtgtctattaaaatcttttacccatttaagagttatggactttcggctgggagaggtggctcacacctataatcccagcactttgggaggctgaggcgggcagatcacctgagatcagaagttcaagaccagcctgggcaacatggcaaaaccctgtctctactaaaaata

SEQ ID NO: 2302 - DNA, 419 bp, Homo sapiens
agtacctttatgatttcatttccttctttatccatctggtattcattttgacaaatggtgtgagctgggaaataacgtgtattatttatttatttatttcccggatgggtactcaattctttcatcactgttaaaaagcacgtatttgtgtgtgtgtgtgtgtgtgtgtgtgtgtgtgtgtgtaactattcctaaagtgaacatcttgaacagctggacactgaaggtaacgcagctctagactttgggtcatcattagaaataccagcttaacaggcagaaatatcagcttaacaggcagatgtggcactttctaacagatgtgagcttttgaatcaaacggattgacatttgacattcaaatccagctttgcagctcactgctggtgcaactttgagcaaaccaaggatcctccctg

SEQ ID NO: 2303 - DNA, 1838 bp, Homo sapiens
cttgatgtcttgtttccagtcccttcagaaattatggtggagatacacacatacacattaatggaataaacactcttccctcctctcccttggggctccttcccccaaagaggtccattgtccacaagtactcatttgtgggactcaatatgttcccagccacaacaagagcattacattagaataggagctaacatgtgggaatcagcatatgtttagaattacatcttacacactgaaaaatgcactggaagagcagccattattgacagagacggtcctggctaatagatctgcctagttttaggctgcttaggggaacaggggtcctggaataagaagccccaccccctcctatgaagagaggaaagctggagacaaaaagaggaagcaagagatgaattgcaaaaaactaatcagattgcaacctcaaggtaacattttgcataataagttctaacaatgttttcttgtttatatcagcctcctcctcttagcctggcttactaggctggtgtttaattccaatgcttctgggttaatttattcaactttattatccttactatagtagcctcccctagcgttctcccctacctctcaaaggtctcatctaagtgtgtataaagctgttaaatagaggagaggaatcaggatgaactgcacagcattttcttaaggcctgtgggttctggagcctatgcttcagcaactgaagctgaactgtgtggttgttgctaacattggtgtatccaccactaagcctcagaaataaaactttactgatatctttgaatcccatgtgtgtccttccctgaatgcattgctttgtcacccagaggtaacagctatccagcattcagtgcttatcatccccatgtctttctttattggttttctaaatttggaatatccctggagacaactttggcaactgaagctaaactgtgatggttgttgacctctgatgtgctactttttaatcaagaacttattttccctctttctctctcagctcccacaggcccattctggtgactcatgacttgtatacacagaacaacagagaaaagaaaaatagaattagataaacaagcaggggcaacagtgagggctatgtcttacaaagaaccatttttaattgaattcattttctctcttgaaattcttttttttttccctcaaaagtgggaaaaaattctcaaataacaacagcaaaccaagaaagcagcttagtctgcactgcatttgcatttcttagtttcattccctattcaaaaatgtcttaggcaaatgtgtgggaatgaacatgcactttaaaattatgggacctagtagatttaatggaatgagccctggattgggagccaggggacctggctttgaatggtcccaacccaggcacttatttaccttagtttcttcacttataaaattaaacacaccatctactgatgaatggataaacaaaatgtgatatatccacagaagggaatcttgttcagctgtgagaaggaatgaagtatggacatgtgctataatgtggatgtgcgttaaagacattatgctaagtgaaagaagccagacacaaagaccatacatttcacgattccacttacatgaaatgtacagaatagctaaatctaaggacataaagtaggttagctaatgggtacaggtttcattctgggttgatgaaatgttccaaaattgattgtgctgatggttgtatttaaaactctgcatatactgaaaaccatttaattgtacattttaaatgagtgaattgtatgctatgtgaattatatctcaataaagttgttcaaaaaaaagagaaa

SEQ ID NO: 2304 - DNA, 667 bp, Homo sapiens
cccccatatgacatattgagaaggacacaatcagaaatatcacttcagtgattaaaaaaatgcataacgtcaacctaatcatgaaaaacaaaattagacaaacccaaattaaaagacgtcctaaagacaattagccagtattcatcaaaagtgtcaaggtcatgaaagccaggaaagtaggaactgtcacagattgagggagactaagaagagagaacaaataaatgaaatgtgagattggattctggagtagaaaaagaacaatacaggaaaaatgggtgaaattcaaataaggtctacagtttagtaagttatctaaaataaggtctatagtttagttatctacagttagtattatgaaaggtctttgttctttttcatacttaattttttatattttcttaattgaaaacattacttttacaataggaaaaataattttacttgtttatcaccttttcctttctaatatgttcatttattcaaaactacatcatacagagtaatataaaagggtatataaatagcaactttgcttattggctcattttgcctcccatatatacctaccacagctcttgctgtgagcattctccttagcacgacaacattcactgtaggaaaaaggtatgggcatcacgatcactacgtgaaaagggctcagtgg

SEQ ID NO: 2305 - DNA, 388 bp, Homo sapiens
caagggcacaccaggctaatttttaatcagatggatttagtgatagcaaataaagagaaggagaacaaaaccctcagccaggctattgtgaatgggtgttaccaaaaaatggcattagcagggcaccaggggccaggccagctccaggcagccccgcatctgctcagcaatccccggagtcttctagggggcctggggcagccggaacctggccgggtggaggatttctaccacgagaaagtcagggccctccccgaaggagcagaagctctgcgggtgactgtttgggaagctggtctgctcctgatactctgcaggaagagaatcacactctttagaccggggtctcagatttcagccggacgggaactctctgcagggccggtgg

SEQ ID NO: 2306 - DNA, 367 bp, Homo sapiens
agtctagctttaaataattcaatttaaataccttgagataaggcatcaaggccttgtatataaatatgtttttaaaaatttcctgtgttggtcgagcgcaatggctcacgcctgtaatcccagcactttgggagaccaaggcgggtggatcacctgagatcgggagttcgagaccagcctgaccaacatggagaaacccagtctctactaaaaatacaaaattagctgggcatgatggtgcatgcctgtaatcccagctactcaggaggctgaggcaggcgaatcacttgaacccaggtagcggaggttgcagtgagctagattgcgccattgcactctagcctgggcaacaagagcataactgtcc

SEQ ID NO: 2307 - DNA, 388 bp, Homo sapiens
tttttttttagctcatttgctattgttagtgttagtgtattttatgtgtggcccaagacaattcttcctcttccaatgtagcccagcaaagccaaaagattggacatccctggagaacatcacaggtatataacacacactgctgtgggttgaattgtatcccctagaagatacgttcaagccctaacccctgggacctatggtgtgacctcacctggatagagggtctttgcagatgggatcaagtaaagatgatgtcatgctggaggaggatgggccctaaatccaatggctggtgtccttataagaaaaagtttggacagtcacagatagccaggaaaacactgtgatgacagaggcagagactggggttaggagtctatgagcc

SEQ ID NO: 2308 - DNA, 406 bp, Homo sapiens
gctgtgccgcctactactactaaattcgcggccgcgtcgacagaacaggagacgagaaggaggggagagtgaggagaggaggagagaggcttgtcaaaatctttttagtgcacaaaactaattttgttcatcttggatttggtgagctgggtaatattctgtgcacggctcctaaatgaattattaaatgtcaactcaagatggcttaactaaaatactcaatttaataaccaaaagtatctaaggtaacaacaacaattttgcaggtgattgtagagttgtcaagtcaaaccattatagacaagcatttggggttttcacataatctccttccacatctcatcttctgtcactaaatacccactctggtgagcatattccatttcaataaagatcatcgcttcgg

SEQ ID NO: 2309 - DNA, 402 bp, Homo sapiens
gctgtgccgcctactactactaaattcgcggccgcgtcgacagataatctccttccacatctcatcttctgtcactaaatacccactctggtgagcatattccatttcaataaagatcatcgcttcggtgccagcttctttttattcagatcgagccagaaaaccttttttttttttctaaaatataaagcaaaacaagatctcagtcacaaccaccaaatctttattaatgcattccttgtgctacttctgaatattaataaaaattaataattaattttgcctttggcattgcaagatatactagttttaattagtgtactgtactcctatacaattaaaaaataattgatgtccatgaaaaaaaaaaagtcgacgcggccgcgaatttagtagtagtag

SEQ ID NO: 2310 - DNA, 680 bp, Homo sapiens
gctgtgccgcctactactactaaattcgcggccgcgtcgacagaacaggagacgagaaggaggggagagtgaggagaggaggagagaggcttgtcaaaatctttttagtgcacaaaactaattttgttcatcttggatttggtgagctgggtaatattctgtgcacggctcctaaatgaattattaaatgtcaactcaagatggcttaactaaaatactcaatttaataaccaaaagtatctaaggtaacaacaacaattttgcaggtgattgtagagttgtcaagtcaaaccattatagacaagcatttggggttttcacataatctccttccacatctcatcttctgtcactaaatacccactctggtgagcatattccatttcaataaagatcatcgcttcggtgccagcttctttttattcagatcgagccagaaaaccttttttttttttctaaaatataaagcaaaacaagatctcagtcacaaccaccaaatctttattaatgcattccttgtgctacttctgaatattaataaaaattaataattaattttgcctttggcattgcaagatatactagttttaattagtgtactgtactcctatacaattaaaaaataattgatgtccatgaaaaaaaaaaagtcgacgcggccgcgaatttagtagtagtag

SEQ ID NO: 2311 - DNA, 947 bp, Homo sapiens
  misc_feature (355)..(355): n is a, c, g, or t
  misc_feature (393)..(394): n is a, c, g, or t
  misc_feature (407)..(407): n is a, c, g, or t
  misc_feature (441)..(441): n is a, c, g, or t
  misc_feature (462)..(462): n is a, c, g, or t
  misc_feature (480)..(480): n is a, c, g, or t
  misc_feature (484)..(484): n is a, c, g, or t
  misc_feature (487)..(487): n is a, c, g, or t
  misc_feature (517)..(517): n is a, c, g, or t
  misc_feature (520)..(520): n is a, c, g, or t
  misc_feature (542)..(543): n is a, c, g, or t
  misc_feature (554)..(555): n is a, c, g, or t
  misc_feature (557)..(557): n is a, c, g, or t
  misc_feature (561)..(561): n is a, c, g, or t
  misc_feature (622)..(622): n is a, c, g, or t
  misc_feature (653)..(653): n is a, c, g, or t
  misc_feature (658)..(658): n is a, c, g, or t
  misc_feature (720)..(720): n is a, c, g, or t
  misc_feature (726)..(727): n is a, c, g, or t
  misc_feature (759)..(759): n is a, c, g, or t
  misc_feature (776)..(776): n is a, c, g, or t
  misc_feature (789)..(789): n is a, c, g, or t
  misc_feature (795)..(795): n is a, c, g, or t
  misc_feature (798)..(798): n is a, c, g, or t
  misc_feature (820)..(820): n is a, c, g, or t
  misc_feature (822)..(823): n is a, c, g, or t
  misc_feature (825)..(825): n is a, c, g, or t
  misc_feature (894)..(894): n is a, c, g, or t
gcaccctaccacgtcccaggcgaagggaccgagcccccagaccaacaaggaactgggaaactttttccggagcctgtggggaccttatgctggctgggcccaagcgggcctccttggcaatgcatttgatggccaccagcttctgcgtcctcttatcttctgccaggatcacctccgagaaggcccccctatcgggagaggggattcacaaggtgaagaactggaaccccagcttccctccagcctctcctccattccctatgggttctgtgaccactgctggaccaaggacgtggatgaccctcccctagtcactcatccatcccctggctccagagatggtcacatgacccanccctcggccagtcaaagtagtctctcccctggccacannaattgatcatatnatgcaagccagcaaaatagcactttgagaatgantctcctgttgagactggtagnatgtaagcactggacgcnaatngcnatcatctttcccaccacctgaaaaaagccnacntgaaaatgaaattaacaaaaannaaatccaaccnnanaaanagcacaaatatattctacctgataacaattatgtgtcacctctgagatccagcacatgacnctgaggtctacaccctgggacttattggatntcatntgatacagttaggttcatccctttttccatgctaattgcgagtacggtggctaatttaacancccttnngaaccttaaagaacacatcaacatacacccgngaacttttttagaaaancaaaatctctacngctttngancctgggtcaaaaaaaagaaaanannanagaaatacaaaactttaggccctgccccagatttactaaatcaatctgcagtttaacaaaatcctcagntgatttctatgctcattgaactttaagaaccagtgttttagaacagattctta

SEQ ID NO: 2312 - DNA, 508 bp, Homo sapiens
gcagctgttacggggcagctggctctggtgcagctgctggtggagaggcacgcggatgttgacaagcaggacagcgtgcatggctggacggccctcatgcaggcaacctaccatgggtcagtgccagccccacgccctcagcgacaaggccagacagatgctctggcctgagatggaggttcccaatgggctcttctggtcctgagatgctgcatacaaaccccaggactatgacgacattgaggcatggaaaaaaaaaaaaaagcggcacaggctcattttagtcccacccttctgtgtccagatttcctgttcccccatcacagaatttcacaatggccctgaaaaaccatgcagcaggagcattttatgcagagagataaggttctctaggttggtttcagttgaacacagtgactgattcattggagttttcacattgagatatagtgacctccttaagtagctcctgtatgaagtaaacattggttattcatacaaatgtcgt

SEQ ID NO: 2313 - DNA, 550 bp, Homo sapiens
cccatctgacaccaagtccagtgttcctgtaccacatgcaccctcaagtgggcacacaagcaggaaagaacctcacgaggccatttaatctttggctgtttcaaggaaggactggcccctgaactaacacatcagaaacagatcctcaagtggggagctgaatgctacctggtgttcctatgatccattcctgctctgtttactctcccactgcctgaatggctagttcacacctcctcccctaactgctggcagagggaggggccttgcttcccatttcactaagaaaatttaagcctgggcgtggtggttcatgcctgtaatcccagcactttgggaggccgagatgggcaaatcacttgagctccggagttcaagaccagcctgggcaacatggcaaaaccctgcctctactaaaaatacaaaaattagctgggcatggtggcgcatgcctggaggagaattgcttgaacctgggaggcagaggttacagtgagccgagattgcaccactgcactccagcctgggcgacagagcaagactctgcctc

SEQ ID NO: 2314 - DNA, 449 bp, Homo sapiens
gtttctattttctcatcagtagttcaggggaattgtaactgcagggacaaccctgtgttgaggcagctcagactaaagctctctgttgagttatggatatggcctccacaagcattgccatgctttttctgtgggtttgtttggtttggtttttttaaacttttgcactaaaagcagtcagttcctcctgtttcttcaccagtgaaacagcattctgttttgaaagtatagtgacagtgctaggcttttgaaataaagaaggtgagtgggagcagaggtcaacctgagaaactcatcacaagtccaggtggaaggaaagatgcgaccctaactattagaaagccagtccccatagaggtgcactttattagattaggcctctgaccagaacatggacttagccagcccacttgtctatgtgggcttaaaaactggtctatgtctgcttt

SEQ ID NO: 2315 - DNA, 307 bp, Homo sapiens
attgcaaggactggtcaagagaacgtgtttggaaattggaaattaatcatctatgttgaggaaataatttataacatttgagtttctccggtgaatcattaacatagtttccatatttaaatttctgccattatattttttcacattgtctgtcttctttccaaataacttctcagagaaactcttagaaaaagcagtaataattaagggctaaaaaaaagagcttcagtgcacttgtgacatcattttatccgttataattaaccattaaaaattagttaatattagttacctaactaaagttagt

SEQ ID NO: 2316 - DNA, 659 bp, Homo sapiens
gtgacgggacaagtctgcctccatgagacatctggcaatatctggagacatttcagttttgttgttgtggggttctgagacagggtcttgctgtcagccaggtgggaatgcagtgagccaccacagctcactgcagccttgacattccaggctcaagtgatctgcctgcctcggcctcccaaagtgctgggattgcaggcatgagccactgtgcccatccgggatatgattgccttataatgttttgaggtgtgggctgtggcatttacatgcttagggctttgtcagtttttggatatttatcttgtggtgaggtaaagtgttctgagcaaacaaaatgtatgtgagtgtagtctttttaccggctattgtagagtgggcattttcagtcttggcactgttgacattttggattaactaattctttgttgtgggagcctgtcctgtgcattgtaggaatttagcagcatccctaaccttataagttgtcagtagcattccatgtagtgaatactgaaatgtcagcagggcatgctggctcatacccataattcagaactttgggatgctgaggcgggaggaccacttgagcccaggaattaaagaccaatccgggcaatataacaagatcccgtctctactcaaaaaaaaaaaaaaaa

SEQ ID NO: 2317 - DNA, 383 bp, Homo sapiens
gcttttgcagacatgagctgggaagtgaaaagtttgagcctcccaacacacatgttcccaactgaggtggaacaaagggatgctcatctttcatactgtgaataagtgtccttttcttgggtctttttagtgccttttttttttttttttttgcatttttgtattttttttgttgttggtgatttcactattaaaagcccctaagtgtagtgatgaagtgctgactagtgttcctaagtgaaagaaggctgtgttgtgccatatgtagaaaatatgtatattggatgtttcttttaggtctgggttacagtgctgtttgccatgagtacaatgttaatgaatcagtatatattaaataaagtgtcttaaacatgcgttaacat

SEQ ID NO: 2318 - DNA, 261 bp, Homo sapiens
aggactaacaaagcagtggtactggaatgccagctatattaatgagttttgtattaattacatattgaatgaaacaaagatacaaaagacaaaatctagattttgattgttttcaaaaccgtctcacacccaaatgcaaagcagttggaaagtacaagctgagggaggactaaaagatgttttctacattcttctaaataatgagccaatatagtttaaactgactgctgaaaataatttcctaaagtctttatatgtatt

SEQ ID NO: 2319 - DNA, 972 bp, Homo sapiens
acgaacagatgaatgggccaaccactgtgctggagcatgtcattgtggccctgatgagctgtagaaatggaagcttgggattagggtttttctgtgtgtgtgtcgtgtttgttttttttttttcctttctgtggagatcagtgcctcactccgttgcctaggctggtcttggtctcctgggctcaagcaatcctcctgcctctaccttccttagtgctagaatgacaggcgtgagctactgcaccggtgtgtaaattacacgtgtaaatatagtggcttcgaggctctcatgacagtaatgctactctaacattctgatatgctttctaagtgggagagggctgatttcagtgaagagaagcgtcgcacaaagccagcttgtgtctgtgtctccgtgtgtgttttgtgtctcatgtttcaccacagttaatgggtagcttcgctttccagccatcagtgtcatcatcttcatttttccccctttccatttcactgccaaactgttatcactgctggagtaaaagctaggaatgcaagtagtttcccagtttatagctggttgtatcaacccatgacgttactgtttatgaatttgaacattcaaaaaggctaatcttcaaaaaagcttagcaggattttcacaatgactgacagatagtgtcctgaggccccaattatgaagattcttatggttaaaattgagcaagttttttttggagtacattggcacgatctcggctcactgtagcctctgactcctgggttcaacgattctcttgcctcagcctcctgagtagctgggactacaggcgggcaccaccctgcccagctaatttttgtatttttagtagagatggggtttcaccatgttggccggggtggtcttgatctcttgacctcgtgacccgctgcctcggcctcccaaagtgctgggattacaggcgtgagccaccgcacccggtctagcagtga

SEQ ID NO: 2320 - DNA, 685 bp, Homo sapiens
acgaacagatgaatgggccaaccactgtgctggagcatgtcattgtggccctgatgagctgtagaaatggaagcttgggattagggtttttctgtgtgtgtgtcgtgtttgttttttttttttcctttctgtggagatcagtgcctcactccgttgcctaggctggtcttggtctcctgggctcaagcaatcctcctgcctctaccttccttagtgctagaatgacaggcgtgagctactgcaccggtgtgtaaattacacgtgtaaatatagtggcttcgaggctctcatgacagtaatgctactctaacattctgatatgctttctaagtgggagagggctgatttcagtgaagagaagcgtcgcacaaagccagcttgtgtctgtgtctccgtgtgtgttttgtgtctcatgtttcaccacagttaatgggtagcttcgctttccagccatcagtgtcatcatcttcatttttccccctttccatttcactgccaaactgttatcactgctggagtaaaagctaggaatgcaagtagtttcccagtttatagctggttgtatcaacccatgacgttactgtttatgaatttgaacctgggaggcggaggttgtagtgagccgagattgccccactgcactccaacctgggtgacagagccagactgcctcaaaaaaaaaaaa

SEQ ID NO: 2321 - DNA, 466 bp, Homo sapiens
ggcttcaccatgttagctaggctggtctcgaattcctgacctcatgatcagcccaccttggcctcccaaagtggtgagataataggcgtgagccgctgcgcctggtgtgcttaagtctttaatacatcttgagttgatttttgtaaatggtgagggagaagtgtccagttttatttttctgcatatggatatccaattttctcagtatcatttattgaagaggttgtcctttccccagtagatgttcttggtgcctttgttgaaaatcagttggctaccaatccatggatttatttttgagttctctattctgctccattggtctatgtgtttgtttttatactaataccatgctgttttggttattattgctttataatatattttgaaatcaggtagtgtggtgtctccagcttttgaacaaatatttattgaacatctattatatgccaggcaatgctctaag

SEQ ID NO: 2322 - DNA, 388 bp, Homo sapiens
atatgaaggttaaggttaaagaaattgtaaacaagataaaaaggcaaataatggaaatgttggtagaatatataagagatttaatatccctactctacaaggatcacctacaaatcaattgaaaatggtcaaccatgccaggcatggtgattcacacctgtaattctagcactttgagaggctgaggcagaaggatcacttgagcccaggagttcgagaccagcctgagcaagatagcaagaccctgcctctaccaaaaaaaaaaaaaaaaaagctgagtatgatggtgcacatctgtagacctagttacttgggaggctgaggctgaggaggatcccttgagcccaggagttcaaggctgcagtgagctacaatctcaccactgcac

SEQ ID NO: 2323 - DNA, 345 bp, Homo sapiens
tagaagaatgaagctgtgtcctcatctctcaccttatacaaaaatcaactcaagattcatcaaagacttaaatctaagacatgaaaccatagaaattctagaagatacatcagaaaaactcttgtagatattggcttagggaaagaattcatgactaaggacccaaaagcaaatgtaagaaaaaccaaaataaataaatgagacctaattaaactaaaaagcttctgcacagcaaaagaaatagtcagcaagtaaatagacaacccgcagaatgggagaaaatatttgcaaactatgcatctgacaaaggactaaaatatcgagaatctgcaaggaactcaagaa

SEQ ID NO: 2324 - DNA, 358 bp, Homo sapiens
gatgatgacagtgacaaaaatgataacacagataatttccttagactcctcatcccctggatggttttctgcagggctgatgtttatcaccttcttcaaggtttcatactttgcagaatcttgaacaagcctgtgcagattatacctttctttgccatgaacaagtctatgatcatgagaaagttattaacctctctgagcctcagttttctcatctgtaaaatgggaatggtaatagttcctacctcctagtgttactgtgaagaataagttaacatgtgtctaacatttagaagaatgtctggcccttaaatatatatgcatgttgtgtgtttttagattttcctgccaatgagag

SEQ ID NO: 2325 - DNA, 322 bp, Homo sapiens
gaagagttccccacagcacaggacagtgactgtggcagatccttgccagactgcttccttaggtgggacccagatctattcctttttactggttgggcctccctgtgggaatttcagcaactccagccagggttttacaggcagaattctgatctctcagggacaaagcccctgtgaggaggggcagctgtggtcttcatgtttcagcagacctagtcttccctgcatgctggctctgaagattccaggcattctggacaaaggggcctccccacagtgcagtatggctgctccactgagagacagccagagtgatttatta

SEQ ID NO: 2326 - DNA, 432 bp, Homo sapiens
ctgattattatttaatcactggaagtatataaattaaaattagaatgacaggctgggctcagtggctcatgtctgtaatagcagtgctttgggaggctaaggagggaggaccactttaggccaggagtttgaggccagcctgggcaatatagtgagaccctatctctacctacccccacccctaaaaaaagaatgacagataacctaatacagtgacttacaaaaaaagttagtttatttctctgtaacctaaaagtctagataagtggtcttgggcaggtggcaaatactcaaatactcagatttcttctgtcttaatgttctacaatgtgtggctttgaccatatcatcccaattgggagcatcccaatcccaggaagcaggctaggggaagcaaaaaagggacaaagaatatatacagactgccccttc

SEQ ID NO: 2327 - DNA, 376 bp, Homo sapiens
tgtatgaactttacctgacattttatcatgccttgagatattaactagtattgtgaagccaatatttaaaactacttttcattttatctttgtgtcatcttattaaaagtgctgtttttggccagacatggtggctcacgcctgtaatccgaggactttgagaagtcgaggcgggaggtttgcttgagcccaggagttcgagaccagcctgggcaacatagtgagactttggctttactaacaaaaataaaataattagccactggtggtggtgcgtgcccgtagcaccagctacttgggaggctgatgcttgaggttggaggatacaaggctgcagtgagctgtgatcgtaccactgcactccagcctgggcgac

SEQ ID NO: 2328 - DNA, 394 bp, Homo sapiens
tctgtacactgaccccctattctgccaccccaaggcggggaccacgtgctccagtcaagatccgcccccctccccaaaatcccatcttgctagagctgcaggtcgtctctggtttctacccagagagctggaggaactccccacaccccttgacccacgcttggtgtccagtcagccggcgagctcggcagcttccccagggacacaaagggttaaatccaggcgaggggactcggtcggatttgcctcctaaacgcattttccagttcattccccagcacaatatgcctgggctggtcccagcctccgtccccaccccacccgtcagaatgggccaccagggccaccccggggtcgggcgcgaggttaacccctcggctgccggcagcccgca

SEQ ID NO: 2329 - DNA, 412 bp, Homo sapiens
attctgtggttttgtttcgacaaaaactggaagttttatgggttccacttttaatcttgttctacttatttgctcattattattaagaatgatttctagtccaggcttggtggctcacgcctgtaatcccagcactttgggaggccgaagtgggtggatcacctgaggtcaggagtttgagaccagcctggccaacatggtgaaatcccatctctactaaaaatataaaaattagccgggtgtggtggcgggcgcctgtaatcccagctacttgcagggctgaggcatgagaatcgcttggacctgggaggtggaggttgcagtgaactgagatctgagatcacgccactgcactccagcctgggtgacagagtgagacttcatctcaaaaaaaaaaaaaaaaagatttctg

SEQ ID NO: 2330 - DNA, 1658 bp, Homo sapiens
tcttatcacactctttcaagtttccttaatgtatctggaaggaatagaagttggattcagaattgataactggcatggtgatgacaaacctgtgtagcaccaaggttctcacagctaacagctgtttcacaaacggcatcttccaaatgaacagtcacctctgctatgcagaaaacccccatcctgctgtgagcaagttaggctcttcaagaactggacaacttttgggtgaggtgttcaatatcaaactgcataatcattagccattttcatatatactattttatagatttaagtctctcaactatcaaaaagtagagcgatttttaggagaaaaaagtcgtggggactgagttcaggacaccctgaaactatgcgaccagtaatttttttaaggtattttttcctacaagtaaggtatctgaaaagtcaacgttttgagggtggaatcaagacttttcacttctcctggcaaagagcaacaaggctcttgtctcgtgtccttctgtgtgtctctgtcaggatcacagcagctgtgctcttggtctgcttactcctctgtaatccacgtatgcagaagggagttaataaggtgatcaccatctccccagaattcaaaggtctttgcctctataaggtctgcccctatggggccaggaaaatataaacctatataaggacttgcaagagagcataaagaaggtagaaaaggtttacttgttgggttttcaagccttcaagttgaatgagtcttagcttttgctgggcagttgttctggacaagtcatcagtttcatgtggagaactcagtgtaagcccaaggctaatgaatgagaggggtcccatggaaacacagctgaaatgaaatgggactttatccatcttctttgagaatggaagagcttttgtgaagcagtacatcattgctcaagataatggttgataagcattagattttatagatctaataaggaaaatattttattatctcaagttaacaaaacatttttttacctctcgagtgcctcataggaccaactattactctttggcttttatttttctttttgtattatttttatatattctttaaccttgctgagctagtattgactgaaatctttagaactttgcctctgggcaatgaagtaatgtttctctaccctaagatatctatttgtataatctctggctgtaatgatcactttggaagatttcctttgcatctctaattatttctttttaatggaataaggcataagggggaataaatatattgtaaccaatgttatgtaaacccatatccatacaggccaggaaagccaaatgaagtcatttccagaattctagtgtgaaaaacctatttttgaaaagtggggagatggctttgtgtagaactgggtgggttttctctgcagactaagtctagccatgagcttccagatcctttagttttatcagccttgtgcttaccccattttcataaatgctactttaacagccagtcttcgtaagtcatggttcctaggttttcctgtcacctcattgaattcatctgtggtaggatattaacgggctcattcaaccaaatgtaatgtgtgcctcagacctatttagcatggttggggggcatcagcaggacaaaccaacaggtactc

SEQ ID NO: 2331 - DNA, 360 bp, Homo sapiens
gcttttcctgaacatgttttcagaatttaaaattgtatatggaaaacaaattacatgaaagatttgagcatttcaaaattttaaacataaaagcataaacgtagataaaatgaaggtgtactatgatatcttcagttttatcagaaatgatgtaaaaattacaacctctttaaaaagtagtgttaatcattaagttagaaaatatatagctgggcatggtggcagatgcctgtaatcccagctacatgggaaggtgaggtgggagaatcgcttgaacccaggcagtggaggatgcagtgagccaagatcatgccactgcaccccagcctgggtgacagaacaagactccatctcaagaaa

SEQ ID NO: 2332 - DNA, 383 bp, Homo sapiens
cccttgtataaaacaaggacagagtaggtcagccccaacactccccctacctgtctggcctttctttcatggaggcacacaacactattcactctctgtagattgaggaggccctaaatccattgctcccttctgtctggacctaaaggacacaagaccttattaagcttcagcttcatttgcataccacatgggatgaggtattcactcctccctggcttgggctggtctgctgaccctgtcttggagtctcagtaagcccaccctttctcccactccctcatctctctccttccatcctgggccctgcctagctctgtcccaacctagaccactccaggaattttccagcctgccagatctggccccccaggagccactag

SEQ ID NO: 2333 - DNA, 330 bp, Homo sapiens
aatagctttctttcatgtcccctccttaattcattatattttaaaaagtagccgggcacagtgtctcatgcctataattccagcactttgggaggctcaggtgggcagatcacctgaggtcaggagtttgaaaccaacctggccaacatggtgaaaccctgtctctactaaaaatacagaaaaattagctggacgtggtggtgcacacctgtaatcacagctactcgggaggctgaggcaggagaatcacttgaacctgggaggcagaggctgcagtgagctgagatcatgccactgcactccagcctgggtgacatgtctcaaaaaaaa

SEQ ID NO: 2334 - DNA, 1402 bp, Homo sapiens
ggccagctctggacagaagcctgggattagtgagctgtgattacatcactccttttctgctcctccgcctttaagagcaagcttctttatgctatccctggatggttttgttccaacccctatgctatgaggtctctcttgcccttggagatttaaagttttgtatcagaaatagatttgaagatcatcatgaccaaatgtagttagtgctatgtgagaaggatatctatcacacaaaatgctttatggtcacagagagattagttctgtctgaagggaaaggggagaagatgacaaacatgccatcggggcaattaacatataacccttccacgggtgagaatactggaccaaatgacctttttggggtgcctttctgttgtgaattttctagtttattaataacccaagaactgtgccttatagtccatagtattcatacctctcaaaaccaaggtacttaggattggggaggaaaaagactctactaatttttaaagtagacctaaacaatttgcactgcctgtgtctttgacctgattttttactctcacctttctttatctgtccagttacctttgtatactaccaaagctttaaccttctgtcctctcaaacttttttaaattttactttatttaactaccaatttatcaaaacagtcatttacacttgacgccagcccactccgaaacagctgctgtctagcttctgctaccagcacttgactatgcttatttgaagatcatcagtgatacactaattaaaactccagtgacttatctggctttgtgttccttcatctatgccacagttgaatcattgaccactttttgcttgaagttctcagctcatgctgctttctgttgagtgcttctcatgctacctcagtggtacttgttaaatgttttccttttctactttccctccatttagtcgcacaaagcccccaccctctatactcgtctctgcctatttaacagatcctacctatgctctaaggcctggttcataggccatcttccctttaaatctttgagctaaaatgttttctcagttctgtagtttttaatctaatttttacttggagcacttttaggatgactgttgccttgatagtatgattttgtacacatttcttaactactctagcagatgttaaaaaaataaaaaaaggagagaaatcatcactgtagcttctgcaatgctgtgcattattagaaatctttaaatatttttcttaatatactgtggtagggagaataatggcaccccaaagatccccatgtcttattctttgagttagtgggtgcagcgcaccagcatggcacatgtatacatatgtaactaacctgcacaatgtgcacatgtaccctaaaacttaaagtataataaaaaataa

SEQ ID NO: 2335 - DNA, 337 bp, Homo sapiens
agtactgtgtcagaccttgtggaagatagacaaagtaatgtcccttaccttaactaatttgatagtctgggaggtgagaccgacttttctgcttattattactgtgtaataaattatgcaaaaacttagcacataaaacagccattttatcatgattattttttggatcagaaattcagaaaggccatagcaaaaattgatctgtgctccatgatgtccgaggcctcagccaggaagatagctgggaaccaaacaactggggctggaggatccccttctaagatggtttcttcactcccaggtttggtgcctgggcaggtttgacaggaaggctcag

SEQ ID NO: 2336 - DNA, 452 bp, Homo sapiens
tctcccttcactttaaaaaaattcaagtcctggccggatgcagtggctaacacctgtaatcccaacattttgggaggccaaggcgggcggttcacgaggtcaggagatggagaccatcttcgccaactggtaaaatttcatctctactaaaaatacaaaaattagctagacatggtggcgctcacctggaatcccagctactcaggaggctgaggcaggagagtcgcttgaacccgggagtcagaggttgcagtgagctgagatcatgtgtggcaacagagcaagactccggtctcaaaaaaaaaattcaagtcctatctcagggtagcaactaaaatgtgagaatttcgtttaaaaattaaagccaaccgtgaacctggggttggagcctgcagtgagccgagatcgcgccactgcactccagcctgggcaacacagcgagactccgtctc

SEQ ID NO: 2337 - DNA, 1430 bp, Homo sapiens
taaagcaatgtgagtccactgaggaggaagagaccctgggatttcaccctctgggttagtctctgtctcaccctgttagaatgtcacgagggactgtactgtcccctctgtcaccagggaagccacaatgagagcttgaaagggtgctgtcaagataaatgtcatccttcttaaaatacatatgattgcctttttgggtgcctcacagagccccagagtgtgagacctgaaagaatgttcagcatctagctccatgtccctgcaaccactctctgtttgccttctgcattctgcactctgcggggcctttgcagccagactgctgtgtcaatgttactttcttgtcactttcctaccctgatggtcacactagcccaccccaagctccgacattgaggttttcatctctgcagggagaggttccaatgtccaccccacccccaggtacccgcctcttcccacagaagcaattttagaattttgcaaaattcttttccccttattgagattaatatttaagattaaaaaaaaaatacccaaagccaaatgcagttccaaatagtggacataatctcccagggaaatctgggctcgaggcctacaacttaggggctggaatcacaggtctcacatagagaaatagccagcttgaatttgttagtcgtattccttcacctgatgaataacagtgttttaaaacatatttgaaaggtaagtaaaaaactaccatcttgaaggtgaagggagttaagaaaagtaatcaagacctgctcctaagcatatgagaccagatgtaattaatcaatggcaatgcagaacaggaccttggctctaaattaatggttgaccggaagggattggaggcggcagaaccattaaccctacacaagaacactccagcccaaaaccgtgaggaaggtgatatatctctgcattttcccttgttgttgcttgaagtctgtgattggggatttgcgttataaaatgaatattttaaaaagcaacagccctaatagcctctgtgggaactgagtggtttcggactcctcacaggcggtggaaataattaataccatattttatacatctccagagcctttcatcttgaggatctcaaagaccgtagaagacatttaatttctaaagcttgaagtgccccgaggagcaggtagaatttccagcagggccttggtggattaaccaaggccttggattccagaatgtttcatggtaagcactgtggagaacctacatgtcaggttctggagttggccctgagctctatccaccaagccagcaccccaccatccctttgcaggggagtcaaagggccagaactccttgggggaccagaacatggttttccttctgcctatcttagtcatggctcctaaaattgaagctgatatgagctggagtgcaaggagtcc

SEQ ID NO: 2338 - DNA, 293 bp, Homo sapiens
catgtgtcgtggaacaggccaatgatggagcaagtctttaagttactgggagccaaggcaggactgtctaaagcagacagggcagacacagggatttgatgcatacctgatttttaatggcattcctgaaaaatcagtgccagaaagtatgatacctaaaataggacaagggcagccacaaattggtatgcatcatggcaaagtatgacaaagaacttactgagtactctgtcccattttcataaaagttcttgcaggtcctacatgtgagattatcctgtgaaagttcattt

SEQ ID NO: 2339 - DNA, 379 bp, Homo sapiens
gagtaacatcttattttataaattatttttggcttaggataggcctaatattaacaaatgtgtttaatattctattacatagaaagtagacactggtggaaggcccattaagatgtcatgatgggccggacatggtggctcatgcctgtaatcctaacactttgggagtccgaggtgggcgaatcacctgaggtcaggagttcaagagcagcctggccaaaatggtaaaacgctgtctttactaaaaatacaaaaattagctgggcgtggtggcatgcgcctgtaatcccagctactcgggaggctgaggcaggagaatcacttgaacccaggaggtggaggttgcagtgagctgggattgtgccactgcactccagcc

SEQ ID NO: 2340 - DNA, 1827 bp, Homo sapiens
atgcaaccaagaggcttggggctccattgcttcccccgctcccacccataggttggaagctctacccaggcacagtgaactcagatttgggccctgattgcctttgcctcagcttgcttgtaaggcagaggtttcacaagagaaacaaaatggctaccacccagcccattgcccagaatggtggttcagagattttgtccagagggagagacagtgtataagaatagagctctgaagctctctcaagaagaatggaatttatttgaaacagtgtcagaaacttcccttaattaaaaacaacatgaaccgtaagtcagctagttaatcaggtaattccaggggaagacacagctaaggagcccttctaaggtcaaaagaaaccttaaagactggcctcaaaaactagccctgcttggcttaaattataccaaactgcttagtaattaatgctccaaggacttgtggagaacagtagactgatcagacagaagccagtggagcctagtgggctagaaataataccaaaggagacaaacatcttaacagagagatcagggaaagatggtcaaagagactcctgtttaaaaccataccagggtatattctgcgtatgtccaaggctgtaccctctgaagagcaacaaaatgcttcccactgccagctatttcactaaaatagcttagtgaaaacacaaaacaaataactacgagtaactctgcatatgtccaaggctgcaccctctgaagaacaacaaaatgcttcccactgcaagctacttcactaaaatagcttagtcaaagcagaaaacaaataacaaaacaaaacaaacaacaaaaccactctgaagaacaacaacaaaaaccactctgaagaaggggacagggaatcagtatccagaatcgctatagtatgttacctaatatgtccacttatcaacaagaaattgtaagacatacaaagaaactgaaatgttcgacttataaacaggaaaaaagcaggcaacagaaatggcctttgacagggaacagatatcagatttaaaagacaaaaacttcaaggtagccattatatatatattcacagcagtaagggaaaatacaaagataatgtctcatcaaataaagaatatcaataaaggaaatcataagatgaaccaaatgtaaattctggagttgaagactataataactaatataaaaaatcattagaagggctaaataagtttgagctggcagaagaattagaaaactttcaaatagatcaatagaaattatgcaacctcaattccatcttcccattagaaaatagaataggaaaatgaagaaataggatgagaaaatagaacaaagaaatataaacagagcctcagagaaattcaggacgcctttcagtgcaccagtgtacatgtaatgagaataccataaggtgaggagaaagagaagcacaaaaatattcaaagaaataatggctaaaaacatccacaatttattgaacaaacattaatctatactcacaagcatctcaacaaactgtgaacagaatgaatgcaaacatatccacaaacagacacgtcatagtaaaaatgttaaaagtgaaaggaaatgttgaaagctgtaagagaaaaacaatgtgccacaagggtaccccaatagattaacagcaaacttctcatcagaaacaatggaggggatgaaggcagtgggatgatacattcaaagtactcaaaggacaaaagctttgtgaaccatgatcttatttctagtaatgctgccttcaaaaaaaaggtgaaacaaagccctcccagatctgccatatgagaaattgtaa

SEQ ID NO: 2341 - DNA, 626 bp, Homo sapiens
  misc_feature (610)..(610): n is a, c, g, or t
ctactactactaaattcgcggccgcgtcgacttgggcattttcaggtgccaatctgggtcgtgaacctccacatctggggcatcaatgtccactttgggccctttaatgtcaacatctggcactttcatttcaccttctaccttgggcacagacacatccatatcccctttgactttggggcctttcaagtgtaagtccacatcgggcatggagatcttgggggccttgaaatgcatctcaggcatcttaaacttggggcccttcaacttcccttctggaccttcaatatcaatatcaccaacattcacatccatcttaggggctttcacatcaatttcaggacccttcaagtctccttccactttgggaagggaaacatctacatcagttttcagtttaggggctttcaaattaagtccaacatcaggcatagagattttgtgcgtctgtatattcatgcttggcatcttgaacttagggccttttagtttcccctctggagcttcaagattcacatctggaacatcaatgtccaccttgggtcctgaaacaccaaggtcagccttgggcaggttcatatccacctctgggccctgtcgacgcggccgngaatttagtagtagta

SEQ ID NO: 2342 - DNA, 373 bp, Homo sapiens
atccccacctgtgtgctcatccccacctgtgtgctcacctgtgtgctccatccccatctgtgtgctcatccccacctgtgtgctatccccacctgtgtgctctagattcacatctggaacatcaatgtccaccttgggtcctgaaacaccaaggtcagccttgggcaggttcatatccacctctgggccctctcctttaaagccaggcatgctgaacttgggcatttttaccttgggcatcttcaggtgccagtctgggccatgaacctccacatctggtgcattaatatcaactttggggcctttgatgtcaacatcaggagcttgtatctctccttctacttttggaactgttacatcataatctcctttc

SEQ ID NO: 2343 - DNA, 163 bp, Homo sapiens
catactgaacttgggcattttcatcttgggcattttcaggtgccaatctgggtcgtgaacctccacatctggggcatcaatgtccactttgggccctttaatgtcaacatctctccctttgactttggggctataatgcatctcaggcactctaacttgggcc

SEQ ID NO: 2344 - DNA, 778 bp, Homo sapiens
ctactactactaaattcgcggccgcgtcgacttgggcattttcaggtgccaatctgggtcgtgaacctccacatctggggcatcaatgtccactttgggccctttaatgtcaacatctggcactttcatttcaccttctaccttgggcacagacacatccatatcccctttgactttggggcctttcaagtgtaagtccacatcgggcatggagatcttgggggccttgaaatgcatctcaggcatcttaaacttggggcccttcaacttcccttctggaccttcaatatcaatatcaccaacattcacatccatcttaggggctttcacatcaatttcaggacccttcaagtctccttccactttgggaagggaaacatctacatcagttttcagtttaggggctttcaaattaagtccaacatcaggcatagagattttgtgcgtctgtatattcatgcttggcatcttgaacttagggccttttagtttcccctctggagcttcaagattcacatctggaacatcaatgtccaccttgggtcctgaaacaccaaggtcagccttgggcaggttcatatccacctctgggccctctcctttaaagccaggcatgctgaacttgggcatttttaccttgggcatcttcaggtgccagtctgggccatgaacctccacatctggtgcattaatatcaactttggggcctttgatgtcaacatcaggagcttgtatctctccttctacttttggaactgttacatcataatctcctttc

SEQ ID NO: 2345 - DNA, 1795 bp, Homo sapiens
ggcactcccgtcctctgcatggggtcaggtgcttctgtgcttgctgtcctacctctctccacagcagggctctcaaaaccattttgatcccccattggcagagggttcccctctttacagagttcagtcattaaaagcatggatcagctgttaatctcattggaggagggaactgtttcctgcattcattcatctgggaaccttcttgagtagccactgtctgccagccactgctctagagatgggaaaacagcacggaacaaaaccaaggtctttcttccagcgaatttatatccttcaggaagctggttcctgccaccaacttagcaggcaacagttctcctcccctagtggcacagggtaccagttttgtaggaaaagtggtccagcaaaggaagaaagcagaccaacccagctgccttaccttattctggggccattcccccagcgatgagagctgctcttgtttctactgccaccatctcttctggctgcacttcacctgctgcttgagcttctgaccttccttcagttccaccaaatgaggacaggaaatagcagtcaagacccctggccctgctgagcgtgaaacagaagcaatggatgagtgctggacgaagaatggcctgggcagaacaaatagggagcatttgaaagcttctggctgataaatctccaggtgcatcccggttgccacgcctgcccccattaacctgctcctggtaaatactgatccagcagctgctccaggagaggccgtctttttttcccagccacgctgtgtcttgcatgagactcctggggcctgggcacagagagaaaagaattgagactcaggaggctcagtgggtgagaaaatgcaaagtggcttcacagacacagggctgtgggagcagatcgacggggaacttgggagatgaacttcagggccttccgacgccttgtctcaggaacatgctttgagaaaaatggtagcatcctttccataactcagtctctcttccctagtttccctgaagtgtgacgttttagtatctggagctcagtgatccccatgaatgagggataaagtttcactcttggtattttctaactagtgctagggaaagtcctgagacacgatcacagccactgcttggcatacagggcctccacccaataagcaaactggagattcctcagcctctcgtggacacccacatctcattcttctcacagcagagaagctctcccttcagcctgagctgtcttctttctgctgcagtgcagcctgctccctcctaccctggcctcaaggaaggtgggaaacatcttctgcatttcaaagtcctcactttgacttatttggccttcatcttggcatggaaggtggcaggcagaatggaaatactccccccaaacagaacagatattcttgcgtgtgtaagggcagaagggacaagctctctatcccatgagactaggggccggagcccacctgcctttccccacaacttttcctgctcaaacccactcctcttgacacactggaatctgtattatatatatttttaagaaaatacaatgatggttgtctggttttgttgtttttacaggtgttgtggaataaaaactgtaagaaaattaagtatttaaaatgttccaataaagtggggttttttgttattctaatatattattgtgtacctattgtaaatatgaaacactcctattttgcaagctgaggacacaatttgtactgttgttatatataaataaagtttactgaattaaaaaaaccttaaatctttaaata

SEQ ID NO: 2346 - DNA, 899 bp, Homo sapiens
aacaagaaaccctttctgggctggtagaaatcctgtaatgttgcctttagactgattatccactgaaggaactcttgtctgaaatagaaagatcccacagaatgccatggtcctgaggaacattaaaataaatagaaaatgagttcaggcacttagctttacaaattgatcctggttctcctggcagaaaggtagatacaggtgacgccagctgagtggaaggttgctgcctgttctttcatctggcttcataagaaccaacatggaatttgtgggtgagctggtgagaagtttttgtctgcagcttgtattagggcccctgaactcccatgtctgcctctctgaggcctgggtgtcctaaggctggaagttgtggatatgggtcgtgtagagacttcaccatgcctccactgttactcaccccaattccttccgcttccctccagcctgtccccatcgatgataacttctgtggactggacatcaaccagcccctgggaggctcaactccagtggagggcctgaccctgtacaccaccagcagggaccgcatgacctctgtggcctcctacgtttacaacggctacagcgtggtttttgtggggactaagagtggcaagctgaaaaaggtaagagtctatgagttcagatgctccaatgccattcacctcctcagcaaagagtccctcttggaaggtagctattggtggagatttaactataggcaactttattttcttggggaacaaaggtgaaatggggaggtaagaaggggttaattttgtgacttagcttctagctacttcctccagccatcagtcattgggtatgtaaggaatgcaagcgtatttcaatatttcccaaactttaagaaaaaactttaagaaggtacatctgca

SEQ ID NO: 2347 - DNA, 957 bp, Homo sapiens
ccgccgccaccggcgggagccagagctgccgggaggagcggcatccgcgccagactggagcgggagggcggcggagggcagttgctgggaatttttcagccgagagggcgagcgatccggagagagaccccgagagcttgggagcggtagggcgtgcgagcgccgcagccagcggagcaaacctcgaaatagatctggaaagccaggctcccggaggaaatgggactgtgaacgaaccggagagcaagaagggaaggaagcgccgggattgctgatgtcagaggagcccggaaagtcgcgctggaaaaatctgaagacagccggggctctgcttcttcctcaggagagacaccgccggccgcccccacacgccccctcggcgcctccgggtgccccctgagagccggcgacagcgcccagccgggctgctgcggggcgacggaggactgaggggcgcgcggagcggagaccgaggagcgacttcaggaatacagataagtgtctggtggcttgacgtggattttaatgaatttggactccatgtggatttggtcgtctccctgattccgagctgcgggcagggagaggggcctcgcgccgccctcagcagccggcggcggccgaggtagaccgagcggggacggaaggacagaccgacgtcgccgagctgggtgcctggaacaacccagcaagagcaacacaagtggtcctaaatcacccaagggccatgagcaggagggtggcctgaaatcatgggaccactgatagaaatggtgggaatgacaactcaagacctcaggtcagcacggggagaaggtgggactagcagcaccctgtttgtttcttccgaggggactgggtctggggaggcaggtgctgggtcaccaggttctgctgcacaatgatcaccaatctctcgagctaaaacagaaccctcggagtttgtcaccatcatac

SEQ ID NO: 2348 - DNA, 6851 bp, Homo sapiens
  misc_feature (1857)..(1857): n is a, c, g, or t
  misc_feature (1864)..(1864): n is a, c, g, or t
ccgccgccaccggcgggagccagagctgccgggaggagcggcatccgcgccagactggagcgggagggcggcggagggcagttgctgggaatttttcagccgagagggcgagcgatccggagagagaccccgagagcttgggagcggtagggcgtgcgagcgccgcagccagcggagcaaacctcgaaatagatctggaaagccaggctcccggaggaaatgggactgtgaacgaaccggagagcaagaagggaaggaagcgccgggattgctgatgtcagaggagcccggaaagtcgcgctggaaaaatctgaagacagccggggctctgcttcttcctcaggagagacaccgccggccgcccccacacgccccctcggcgcctccgggtgccccctgagagccggcgacagcgcccagccgggctgctgcggggcgacggaggactgaggggcgcgcggagcggagaccgaggagcgacttcaggaatacagataagtgtctggtggcttgacgtggattttaatgaatttggactccatgtggatttggtcgtctccctgattccgagctgcgggcagggagaggggcctcgcgccgccctcagcagccggcggcggccgaggtagaccgagcggggacggaaggacagaccgacgtcgccgagctggaatcatgtgagggccaaccggggaaggtggagcagatgagcacacacaggagccgtctcctcaccgccgcccctctcagcatggaacagaggcagccctggccccgggccctggaggtggacagccgctctgtggtcctgctctcagtggtctgggtgctgctggcccccccagcagccggcatgcctcagttcagcaccttccactctgagaatcgtgactggaccttcaaccacttgaccgtccaccaagggacgggggccgtctatgtgggggccatcaaccgggtctataagctgacaggcaacctgaccatccaggtggctcataagacagggccagaagaggacaacaagtcttgttacccgcccctcatcgtgcagccctgcagcgaagtgctcaccctcaccaacaatgtcaacaagctgctcatcattgactactctgagaaccgcctgctggcctgtgggagcctctaccagggggtctgcaagctgctgcggctggatgacctcttcatcctggtggagccatcccacaagaaggagcactacctgtccagtgtcaacaagacgggcaccatgtacggggtgattgtgcgctctgagggtgaggatggcaagctcttcatcggcacggctgtggatgggaagcaggattacttcccgaccctgtccagccggaagctgccccgagaccctgagtcctcagccatgctcgactatgagctacacagcgattttgtctcctctctcatcaagatcccttcagacaccctggccctggtctcccactttgacatcttctacatctacggctttgctagtgggggctttgtctactttctcactgtccagcccgagacccctgagggtgtggccatcaactccgctggagacctcttctacacctcacgcatcgtgcggctctgcaaggatgaccccaagttccactcatacgtgtccctgcccttcggctgcacccgggccggggtggaataccgcctcctgcaggctgcttacctggccaagcctggggactcactggcccaggccttcaatatcaccagccaggacgatgtactctttgccatcttctccaaagggcagaagcagtatcaccacccgcccgatgactctgccctgtgtgccttccctatccgggccatcaacttgcagatcaaggngcgcctncagtcctgctaccagggcgagggcaacctggagctcaactggctgctggggaaggacgtccagtgcaccaaggcgcctgtccccatcgatgataacttctgtggactggacatcaaccagcccctgggaggctcaactccagtggagggcctgaccctgtacaccaccagcagggaccgcatgacctctgtggcctcctacgtttacaacggctacagcgtggtttttgtggggactaagagtggcaagctgaaaaagattcgggccgacggtcccccccatggtggggtccagtacgagatggtctctgtgctcaaggacggaagccccatcctccgggacatggccttctccattgatcagcgctacctgtacgtcatgtctgagagacaggtcaccagggtccccgtggagtcatgtgagcagtatacgacttgtggggagtgcctgagctctggggaccctcactgtggctggtgtgccctgcacaacatgtgctcccgcagggacaaatgccaacaggcctgggaacctaatcgatttgctgccagcatcagccagtgtgtgagccttgcagtgcatcccagcagcatctcagtatctgagcacagccggttgcttagcctggtagtgagtgatgctcctgatctatctgcgggtatcgcctgtgcctttgggaacctgacagaggtggaggggcaggtgtccgggagccaggtcatctgcatctcacctgggcccaaggatgtccctgtcatcccgctggatcaagactggtttgggctggagctacagctgaggtccaaggagacagggaagatatttgtcagcaccgagttcaagttttacaactgcagtgcccaccaactgtgcctgtcctgtgtcaacagcgccttccgctgccattggtgcaagtaccgcaacctctgcactcatgaccccaccacctgctccttccaggagggccggatcaatatttcagaggactgtccccagctggtgcccacagaggagatcttgattccagtcggggaggtaaagccaatcacccttaaggcgcgaaatctgccccagccgcagtccggccagcgaggctatgagtgtgtcctcaacatacaaggagccatccaccgggtccccgctctgcgcttcaacagctccagcgttcagtgtcagaacagctcgtaccagtatgatggcatggacatcagcaatctggccgtggatttcgctgtggtgtggaacggcaatttcatcattgacaaccctcaggacctgaaagtccatctctacaagtgtgcagcccagcgggagagctgcggcctctgcctcaaggccgaccggaagtttgagtgtggctggtgcagcggcgagcgcaggtgcaccctccaccagcactgtaccagcccttccagcccctggctcgactggtccagccacaatgtcaagtgctccaaccctcaaatcaccgagattttgacggtgtctggaccgccggaaggagggacgcgagtgaccatccatggcgtgaacctgggtctggacttctccgagatcgcccaccatgtgcaggtggctggggtgccctgcacgcccctcccaggggaatacatcatcgctgagcagattgtctgtgagatgggccatgccctcgtgggaaccacctccgggccagtacgcctgtgtattggcgagtgtaagccagagttcatgacgaagtcccatcagcagtacaccttcgtgaacccttctgtgctgtcactcaacccaatccgaggtcccgagtcaggaggcactatggtgaccattaccggccattaccttggggctgggagcagcgtggcagtctacctgggcaaccagacctgcgagttctacgggaggtcaatgagtgagatcgtgtgtgtctcacccccatcatccaatggccttggcccggtccctgtttctgtgagtgtcgaccgagcccatgtggatagcaacctgcagtttgagtacatagatgaccctcgggtccagcgcatcgagccagagtggagcattgccagtggccacacacccctgaccatcacaggcttcaacctggatgtcattcaggagccaaggatccgagtcaaattcaatggcaaagaatctgtcaatgtgtgtaaagttgtgaacacaaccaccctcacctgcctggcaccctctctgaccacggactaccgccctggcctggacactgtggaacgcccagatgagtttggatttgtctttaacaatgtccaatccttgctaatttacaacgacaccaagtttatctactaccccaacccgacctttgaactgcttagccctactggagtcttggatcaaaagccaggatcgcccatcattctgaagggcaaaaacctctgccctcctgcctctggaggggccaaactcaactacactgtgctcatcggagagaccccttgtgctgtcaccgtatctgagacccagcttctctgcgagcctcccaacctcaccgggcagcacaaggtcatggttcacgtgggcgggatggtgttctcgcctggctcggtgagtgtcatctcagacagcttgctgaccctgccagccatcgtcagcatcgcggccggcggcagcctcctcctcatcatcgtcatcatcgtcctcattgcctacaagcgcaagtctcgagaaaatgacctcactctcaagcggctgcaaatgcagatggacaatctggagtcccgtgtggccttggagtgcaaggaagcttttgctgagctccagacggatatcaatgagttgaccagtgacctggaccgctcaggaatcccttacctggactatcgtacctacgctatgcgagtcctgttcccgggcatcgaggaccaccccgtcctgcgggagctggaggtacaaggaaacgggcagcagcacgtggagaaggccctgaagctctttgcccagctcatcaacaacaaggtgttcctgctgaccttcatccgcaccctggagctgcagcgcagtttctccatgcgcgaccggggcaacgtggcttcgctcatcatgaccggcctgcagggccgcctggaatatgccactgatgtcctcaagcagctgctctctgacctcatcgataagaacctggagaacaagaaccaccccaagctgctactccggaggacagagtctgtggctgaaaagatgctgaccaattggttcgccttcctcctgcacaagttcctaaaggagtgcgcaggggagccactcttcatgctatactgtgccatcaagcagcagatggagaagggccccattgatgccatcacgggcgaggcccgctactccctgagcgaggacaagctcatccggcagcagatcgagtacaagaccctgatcctgaactgcgtcaaccctgacaacgagaacagtccagagatcccagtgaaggtgttaaactgtgacaccatcacacaggtcaaggagaagattcttgatgccgtgtataagaatgtgccctattcccagcggccgagggcagtggacatggacttggagtggcgccaaggccggatcgcccgggtcgtgctgcaagatgaggacatcaccaccaagattgagggtgactggaagcggctcaacacactgatgcattatcaggtgtcagacaggtcggtggtggctctggtccccaaacagacctcctcctacaacatccctgcctctgccagcatctcccggacgtccatcagcagatacgactcctccttcaggtatacgggcagccccgacagcctgcggtcccgggccccgatgatcaccccagacctggaaagtggggtcaaggtgtggcatctggtgaagaaccatgaccacggtgaccagaaggagggtgaccggggcagcaagatggtgtccgagatctacctgacccggctactggccaccaagggcaccctgcagaagtttgtggacgacttgtttgagaccttgttcagcactgtgcaccggggcagcgctctccccctggccatcaagtacatgtttgatttcctagatgagcaggcagacaggcacagcatccatgacacagatgtgcggcacacctggaaaagcaactgcctccctctgcgcttctgggtgaacgtgattaagaacccccagttcgtgtttgacatccacaagggcagcatcacggacgcctgcctctctgtggtggcccagaccttcatggactcttgttcaacgtcagagcaccggctgggcaaggactccccctccaacaagctgctctatgccaaggacatccccagctacaagagctgggtggagagatactacgcagacatcgccaagctcccagccatcagtgaccaggacatgaatgcctacctcgccgagcagtcccgcctgcacgccgtggagttcaacatgctgagtgccctcaatgagatctactcctatgtcagcaagtatagtgaggagctcatcggggccctagagcaggatgagcaggcacggcggcagcggctggcttataaggtggagcagctcattaatgccatgtccattgagagctgagaggaggagcctcgcattcctgggaagagggacctgtccaagctgtcacactgggagtctcagatggaaggacaagtgatggggatcaggccccagagcttgctgtcccctgagaccccatcctggggagaggggaggactcctctccctacgccagccaagtttcgtcatagccagttccagctgggagagacagtgggcgtcgtccatcctcagtgagaacaccagagaacccggggccgggagaaggtggttcttcaagccgagaggcacgagctggggacagttctgcctctgtgactgctgctttgcatgaaaactcatttgatgtatattggggaaataatgagaactttatttaatttttttaagaaaaagggaaaaaaacagaaataaaacaaaaagccgccctgtt

SEQ ID NO: 2349 - DNA, 9139 bp, Homo sapiens
  misc_feature (1857)..(1857): n is a, c, g, or t
  misc_feature (1864)..(1864): n is a, c, g, or t
ccgccgccaccggcgggagccagagctgccgggaggagcggcatccgcgccagactggagcgggagggcggcggagggcagttgctgggaatttttcagccgagagggcgagcgatccggagagagaccccgagagcttgggagcggtagggcgtgcgagcgccgcagccagcggagcaaacctcgaaatagatctggaaagccaggctcccggaggaaatgggactgtgaacgaaccggagagcaagaagggaaggaagcgccgggattgctgatgtcagaggagcccggaaagtcgcgctggaaaaatctgaagacagccggggctctgcttcttcctcaggagagacaccgccggccgcccccacacgccccctcggcgcctccgggtgccccctgagagccggcgacagcgcccagccgggctgctgcggggcgacggaggactgaggggcgcgcggagcggagaccgaggagcgacttcaggaatacagataagtgtctggtggcttgacgtggattttaatgaatttggactccatgtggatttggtcgtctccctgattccgagctgcgggcagggagaggggcctcgcgccgccctcagcagccggcggcggccgaggtagaccgagcggggacggaaggacagaccgacgtcgccgagctggaatcatgtgagggccaaccggggaaggtggagcagatgagcacacacaggagccgtctcctcaccgccgcccctctcagcatggaacagaggcagccctggccccgggccctggaggtggacagccgctctgtggtcctgctctcagtggtctgggtgctgctggcccccccagcagccggcatgcctcagttcagcaccttccactctgagaatcgtgactggaccttcaaccacttgaccgtccaccaagggacgggggccgtctatgtgggggccatcaaccgggtctataagctgacaggcaacctgaccatccaggtggctcataagacagggccagaagaggacaacaagtcttgttacccgcccctcatcgtgcagccctgcagcgaagtgctcaccctcaccaacaatgtcaacaagctgctcatcattgactactctgagaaccgcctgctggcctgtgggagcctctaccagggggtctgcaagctgctgcggctggatgacctcttcatcctggtggagccatcccacaagaaggagcactacctgtccagtgtcaacaagacgggcaccatgtacggggtgattgtgcgctctgagggtgaggatggcaagctcttcatcggcacggctgtggatgggaagcaggattacttcccgaccctgtccagccggaagctgccccgagaccctgagtcctcagccatgctcgactatgagctacacagcgattttgtctcctctctcatcaagatcccttcagacaccctggccctggtctcccactttgacatcttctacatctacggctttgctagtgggggctttgtctactttctcactgtccagcccgagacccctgagggtgtggccatcaactccgctggagacctcttctacacctcacgcatcgtgcggctctgcaaggatgaccccaagttccactcatacgtgtccctgcccttcggctgcacccgggccggggtggaataccgcctcctgcaggctgcttacctggccaagcctggggactcactggcccaggccttcaatatcaccagccaggacgatgtactctttgccatcttctccaaagggcagaagcagtatcaccacccgcccgatgactctgccctgtgtgccttccctatccgggccatcaacttgcagatcaaggngcgcctncagtcctgctaccagggcgagggcaacctggagctcaactggctgctggggaaggacgtccagtgcaccaaggcgcctgtccccatcgatgataacttctgtggactggacatcaaccagcccctgggaggctcaactccagtggagggcctgaccctgtacaccaccagcagggaccgcatgacctctgtggcctcctacgtttacaacggctacagcgtggtttttgtggggactaagagtggcaagctgaaaaagattcgggccgacggtcccccccatggtggggtccagtacgagatggtctctgtgctcaaggacggaagccccatcctccgggacatggccttctccattgatcagcgctacctgtacgtcatgtctgagagacaggtcaccagggtccccgtggagtcatgtgagcagtatacgacttgtggggagtgcctgagctctggggaccctcactgtggctggtgtgccctgcacaacatgtgctcccgcagggacaaatgccaacaggcctgggaacctaatcgatttgctgccagcatcagccagtgtgtgagccttgcagtgcatcccagcagcatctcagtatctgagcacagccggttgcttagcctggtagtgagtgatgctcctgatctatctgcgggtatcgcctgtgcctttgggaacctgacagaggtggaggggcaggtgtccgggagccaggtcatctgcatctcacctgggcccaaggatgtccctgtcatcccgctggatcaagactggtttgggctggagctacagctgaggtccaaggagacagggaagatatttgtcagcaccgagttcaagttttacaactgcagtgcccaccaactgtgcctgtcctgtgtcaacagcgccttccgctgccattggtgcaagtaccgcaacctctgcactcatgaccccaccacctgctccttccaggagggccggatcaatatttcagaggactgtccccagctggtgcccacagaggagatcttgattccagtcggggaggtaaagccaatcacccttaaggcgcgaaatctgccccagccgcagtccggccagcgaggctatgagtgtgtcctcaacatacaaggagccatccaccgggtccccgctctgcgcttcaacagctccagcgttcagtgtcagaacagctcgtaccagtatgatggcatggacatcagcaatctggccgtggatttcgctgtggtgtggaacggcaatttcatcattgacaaccctcaggacctgaaagtccatctctacaagtgtgcagcccagcgggagagctgcggcctctgcctcaaggccgaccggaagtttgagtgtggctggtgcagcggcgagcgcaggtgcaccctccaccagcactgtaccagcccttccagcccctggctcgactggtccagccacaatgtcaagtgctccaaccctcaaatcaccgagattttgacggtgtctggaccgccggaaggagggacgcgagtgaccatccatggcgtgaacctgggtctggacttctccgagatcgcccaccatgtgcaggtggctggggtgccctgcacgcccctcccaggggaatacatcatcgctgagcagattgtctgtgagatgggccatgccctcgtgggaaccacctccgggccagtacgcctgtgtattggcgagtgtaagccagagttcatgacgaagtcccatcagcagtacaccttcgtgaacccttctgtgctgtcactcaacccaatccgaggtcccgagtcaggaggcactatggtgaccattaccggccattaccttggggctgggagcagcgtggcagtctacctgggcaaccagacctgcgagttctacgggaggtcaatgagtgagatcgtgtgtgtctcacccccatcatccaatggccttggcccggtccctgtttctgtgagtgtcgaccgagcccatgtggatagcaacctgcagtttgagtacatagatgaccctcgggtccagcgcatcgagccagagtggagcattgccagtggccacacacccctgaccatcacaggcttcaacctggatgtcattcaggagccaaggatccgagtcaaattcaatggcaaagaatctgtcaatgtgtgtaaagttgtgaacacaaccaccctcacctgcctggcaccctctctgaccacggactaccgccctggcctggacactgtggaacgcccagatgagtttggatttgtctttaacaatgtccaatccttgctaatttacaacgacaccaagtttatctactaccccaacccgacctttgaactgcttagccctactggagtcttggatcaaaagccaggatcgcccatcattctgaagggcaaaaacctctgccctcctgcctctggaggggccaaactcaactacactgtgctcatcggagagaccccttgtgctgtcaccgtatctgagacccagcttctctgcgagcctcccaacctcaccgggcagcacaaggtcatggttcacgtgggcgggatggtgttctcgcctggctcggtgagtgtcatctcagacagcttgctgaccctgccagccatcgtcagcatcgcggccggcggcagcctcctcctcatcatcgtcatcatcgtcctcattgcctacaagcgcaagtctcgagaaaatgacctcactctcaagcggctgcaaatgcagatggacaatctggagtcccgtgtggccttggagtgcaaggaagcttttgctgagctccagacggatatcaatgagttgaccagtgacctggaccgctcaggaatcccttacctggactatcgtacctacgctatgcgagtcctgttcccgggcatcgaggaccaccccgtcctgcgggagctggaggtacaaggaaacgggcagcagcacgtggagaaggccctgaagctctttgcccagctcatcaacaacaaggtgttcctgctgaccttcatccgcaccctggagctgcagcgcagtttctccatgcgcgaccggggcaacgtggcttcgctcatcatgaccggcctgcagggccgcctggaatatgccactgatgtcctcaagcagctgctctctgacctcatcgataagaacctggagaacaagaaccaccccaagctgctactccggaggacagagtctgtggctgaaaagatgctgaccaattggttcgccttcctcctgcacaagttcctaaaggagtgcgcaggggagccactcttcatgctatactgtgccatcaagcagcagatggagaagggccccattgatgccatcacgggcgaggcccgctactccctgagcgaggacaagctcatccggcagcagatcgagtacaagaccctgatcctgaactgcgtcaaccctgacaacgagaacagtccagagatcccagtgaaggtgttaaactgtgacaccatcacacaggtcaaggagaagattcttgatgccgtgtataagaatgtgccctattcccagcggccgagggcagtggacatggacttggagtggcgccaaggccggatcgcccgggtcgtgctgcaagatgaggacatcaccaccaagattgagggtgactggaagcggctcaacacactgatgcattatcaggtgtcagacaggtcggtggtggctctggtccccaaacagacctcctcctacaacatccctgcctctgccagcatctcccggacgtccatcagcagatacgactcctccttcaggtatacgggcagccccgacagcctgcggtcccgggccccgatgatcaccccagacctggaaagtggggtcaaggtgtggcatctggtgaagaaccatgaccacggtgaccagaaggagggtgaccggggcagcaagatggtgtccgagatctacctgacccggctactggccaccaagggcaccctgcagaagtttgtggacgacttgtttgagaccttgttcagcactgtgcaccggggcagcgctctccccctggccatcaagtacatgtttgatttcctagatgagcaggcagacaggcacagcatccatgacacagatgtgcggcacacctggaaaagcaactgcctccctctgcgcttctgggtgaacgtgattaagaacccccagttcgtgtttgacatccacaagggcagcatcacggacgcctgcctctctgtggtggcccagaccttcatggactcttgttcaacgtcagagcaccggctgggcaaggactccccctccaacaagctgctctatgccaaggacatccccagctacaagagctgggtggagagatactacgcagacatcgccaagctcccagccatcagtgaccaggacatgaatgcctacctcgccgagcagtcccgcctgcacgccgtggagttcaacatgctgagtgccctcaatgagatctactcctatgtcagcaagtatagtgaggagctcatcggggccctagagcaggatgagcaggcacggcggcagcggctggcttataaggtggagcagctcattaatgccatgtccattgagagctgagaggaggagcctcgcattcctgggaagagggacctgtccaagctgtcacactgggagtctcagatggaaggacaagtgatggggatcaggccccagagcttgctgtcccctgagaccccatcctggggagaggggaggactcctctccctacgccagccaagtttcgtcatagccagttccagctgggagagacagtgggcgtcgtccatcctcagtgagaacaccagagaacccggggccgggagaaggtggttcttcaagccgagaggcacgagctggggacagttctgcctctgtgactgctgctttgcatgaaaactcatttgatgtatattggggaaataatgagaactttatttaatttttttaagaaaaagggaaaaaaacagaaataaaacaaaaagccgccctgttaatcccgtccaacttttgtttaattctgatttctgtctcccttccttcttttctcccattcctccttctttatataatgcctatttccaaatgccagagaaagcagagatgctgagagacattggagagaaaatgactgtctccttttccttgaaattaaaaaaaaaaaaaaaaagagagaaagaggagaagaagaatgatgagcacaagtatgcaccaaacacttcgcaaaaacagaggccagtaaaacctggaattatcccggcagccagaggagtatggaacttccagaactttgcacaaattgcaaagccatcaagagctcaccctggctggctggaaactgagctttatctaccacacacctgtatattctcatcttttgagaggagatgtgtacctagatagtaccaatgctttttgctactgttttttgttttgttttatttaatcctaaacctcaacaaatgaggagctggtctttgatatgtttcctttcaatttccctaaagttactatgagaagtggggtgaggtgggcctctcccagaccagacacctggcagccctgcctcatatcaatccctgtcataaaccaggcaccctggggaaacggcctggaggtgtgtgggccaggcctccacgaggttccatttgaaagttgatttggagacataggtgtttgactttggagttcactccaatcatccagtggtccctggcaattaaaaagaaaacaaaaatcaaacactgtttacagcaagcaatacttgaagagcataggttacagaagctgcagtatttattattatgctttctttctttcattctctcgtgcctggagaggggagaccacccttcgctcatatacggaagctcctgaccatctgggcctacagcacttcctcagtagaaatgactgtggcatgcccacgttactaccttctgcctctctttctgcctctcacggacttgtgagtgtgaaggacaagtggatgacttctcactggactttccttctctgtctcttctgatgatgcctaaaactatggataaccaattccctggccctgctgagcgtgaaacagaagcaatggatgagtgctggacgaagaatggcctgggcagaacaaatagggagcatttgaaagcttctggctgataaatctccaggtgcatcccggttgccacgcctgcccccattaacctgctcctggtaaatactgatccagcagctgctccaggagaggccgtctttttttcccagccacgctgtgtcttgcatgagactcctggggcctgggcacagagagaaaagaattgagactcaggaggctcagtgggtgagaaaatgcaaagtggcttcacagacacagggctgtgggagcagatcgacggggaacttgggagatgaacttcagggccttccgacgccttgtctcaggaacatgctttgagaaaaatggtagcatcctttccataactcagtctctcttccctagtttccctgaagtgtgacgttttagtatctggagctcagtgatccccatgaatgagggataaagtttcactcttggtattttctaactagtgctagggaaagtcctgagacacgatcacagccactgcttggcatacagggcctccacccaataagcaaactggagattcctcagcctctcgtggacacccacatctcattcttctcacagcagagaagctctcccttcagcctgagctgtcttctttctgctgcagtgcagcctgctccctcctaccctggcctcaaggaaggtgggaaacatcttctgcatttcaaagtcctcactttgacttatttggccttcatcttggcatggaaggtggcaggcagaatggaaatactccccccaaacagaacagatattcttgcgtgtgtaagggcagaagggacaagctctctatcccatgagactaggggccggagcccacctgcctttccccacaacttttcctgctcaaacccactcctcttgacacactggaatctgtattatatatatttttaagaaaatacaatgatggttgtctggttttgttgtttttacaggtgttgtggaataaaaactgtaagaaaattaagtatttaaaatgttccaataaagtggggttttttgttattctaatatattattgtgtacctattgtaaatatgaaacactcctattttgcaagctgaggacacaatttgtactgttgttatatataaataaagtttactgaattaaaaaaaccttaaatctttaaata

SEQ ID NO: 2350 - DNA, 8528 bp, Homo sapiens
  misc_feature (1857)..(1857): n is a, c, g, or t
  misc_feature (1864)..(1864): n is a, c, g, or t
ccgccgccaccggcgggagccagagctgccgggaggagcggcatccgcgccagactggagcgggagggcggcggagggcagttgctgggaatttttcagccgagagggcgagcgatccggagagagaccccgagagcttgggagcggtagggcgtgcgagcgccgcagccagcggagcaaacctcgaaatagatctggaaagccaggctcccggaggaaatgggactgtgaacgaaccggagagcaagaagggaaggaagcgccgggattgctgatgtcagaggagcccggaaagtcgcgctggaaaaatctgaagacagccggggctctgcttcttcctcaggagagacaccgccggccgcccccacacgccccctcggcgcctccgggtgccccctgagagccggcgacagcgcccagccgggctgctgcggggcgacggaggactgaggggcgcgcggagcggagaccgaggagcgacttcaggaatacagataagtgtctggtggcttgacgtggattttaatgaatttggactccatgtggatttggtcgtctccctgattccgagctgcgggcagggagaggggcctcgcgccgccctcagcagccggcggcggccgaggtagaccgagcggggacggaaggacagaccgacgtcgccgagctggaatcatgtgagggccaaccggggaaggtggagcagatgagcacacacaggagccgtctcctcaccgccgcccctctcagcatggaacagaggcagccctggccccgggccctggaggtggacagccgctctgtggtcctgctctcagtggtctgggtgctgctggcccccccagcagccggcatgcctcagttcagcaccttccactctgagaatcgtgactggaccttcaaccacttgaccgtccaccaagggacgggggccgtctatgtgggggccatcaaccgggtctataagctgacaggcaacctgaccatccaggtggctcataagacagggccagaagaggacaacaagtcttgttacccgcccctcatcgtgcagccctgcagcgaagtgctcaccctcaccaacaatgtcaacaagctgctcatcattgactactctgagaaccgcctgctggcctgtgggagcctctaccagggggtctgcaagctgctgcggctggatgacctcttcatcctggtggagccatcccacaagaaggagcactacctgtccagtgtcaacaagacgggcaccatgtacggggtgattgtgcgctctgagggtgaggatggcaagctcttcatcggcacggctgtggatgggaagcaggattacttcccgaccctgtccagccggaagctgccccgagaccctgagtcctcagccatgctcgactatgagctacacagcgattttgtctcctctctcatcaagatcccttcagacaccctggccctggtctcccactttgacatcttctacatctacggctttgctagtgggggctttgtctactttctcactgtccagcccgagacccctgagggtgtggccatcaactccgctggagacctcttctacacctcacgcatcgtgcggctctgcaaggatgaccccaagttccactcatacgtgtccctgcccttcggctgcacccgggccggggtggaataccgcctcctgcaggctgcttacctggccaagcctggggactcactggcccaggccttcaatatcaccagccaggacgatgtactctttgccatcttctccaaagggcagaagcagtatcaccacccgcccgatgactctgccctgtgtgccttccctatccgggccatcaacttgcagatcaaggngcgcctncagtcctgctaccagggcgagggcaacctggagctcaactggctgctggggaaggacgtccagtgcaccaaggcgcctgtccccatcgatgataacttctgtggactggacatcaaccagcccctgggaggctcaactccagtggagggcctgaccctgtacaccaccagcagggaccgcatgacctctgtggcctcctacgtttacaacggctacagcgtggtttttgtggggactaagagtggcaagctgaaaaagattcgggccgacggtcccccccatggtggggtccagtacgagatggtctctgtgctcaaggacggaagccccatcctccgggacatggccttctccattgatcagcgctacctgtacgtcatgtctgagagacaggtcaccagggtccccgtggagtcatgtgagcagtatacgacttgtggggagtgcctgagctctggggaccctcactgtggctggtgtgccctgcacaacatgtgctcccgcagggacaaatgccaacaggcctgggaacctaatcgatttgctgccagcatcagccagtgtgtgagccttgcagtgcatcccagcagcatctcagtatctgagcacagccggttgcttagcctggtagtgagtgatgctcctgatctatctgcgggtatcgcctgtgcctttgggaacctgacagaggtggaggggcaggtgtccgggagccaggtcatctgcatctcacctgggcccaaggatgtccctgtcatcccgctggatcaagactggtttgggctggagctacagctgaggtccaaggagacagggaagatatttgtcagcaccgagttcaagttttacaactgcagtgcccaccaactgtgcctgtcctgtgtcaacagcgccttccgctgccattggtgcaagtaccgcaacctctgcactcatgaccccaccacctgctccttccaggagggccggatcaatatttcagaggactgtccccagctggtgcccacagaggagatcttgattccagtcggggaggtaaagccaatcacccttaaggcgcgaaatctgccccagccgcagtccggccagcgaggctatgagtgtgtcctcaacatacaaggagccatccaccgggtccccgctctgcgcttcaacagctccagcgttcagtgtcagaacagctcgtaccagtatgatggcatggacatcagcaatctggccgtggatttcgctgtggtgtggaacggcaatttcatcattgacaaccctcaggacctgaaagtccatctctacaagtgtgcagcccagcgggagagctgcggcctctgcctcaaggccgaccggaagtttgagtgtggctggtgcagcggcgagcgcaggtgcaccctccaccagcactgtaccagcccttccagcccctggctcgactggtccagccacaatgtcaagtgctccaaccctcaaatcaccgagattttgacggtgtctggaccgccggaaggagggacgcgagtgaccatccatggcgtgaacctgggtctggacttctccgagatcgcccaccatgtgcaggtggctggggtgccctgcacgcccctcccaggggaatacatcatcgctgagcagattgtctgtgagatgggccatgccctcgtgggaaccacctccgggccagtacgcctgtgtattggcgagtgtaagccagagttcatgacgaagtcccatcagcagtacaccttcgtgaacccttctgtgctgtcactcaacccaatccgaggtcccgagtcaggaggcactatggtgaccattaccggccattaccttggggctgggagcagcgtggcagtctacctgggcaaccagacctgcgagttctacgggaggtcaatgagtgagatcgtgtgtgtctcacccccatcatccaatggccttggcccggtccctgtttctgtgagtgtcgaccgagcccatgtggatagcaacctgcagtttgagtacatagatgaccctcgggtccagcgcatcgagccagagtggagcattgccagtggccacacacccctgaccatcacaggcttcaacctggatgtcattcaggagccaaggatccgagtcaaattcaatggcaaagaatctgtcaatgtgtgtaaagttgtgaacacaaccaccctcacctgcctggcaccctctctgaccacggactaccgccctggcctggacactgtggaacgcccagatgagtttggatttgtctttaacaatgtccaatccttgctaatttacaacgacaccaagtttatctactaccccaacccgacctttgaactgcttagccctactggagtcttggatcaaaagccaggatcgcccatcattctgaagggcaaaaacctctgccctcctgcctctggaggggccaaactcaactacactgtgctcatcggagagaccccttgtgctgtcaccgtatctgagacccagcttctctgcgagcctcccaacctcaccgggcagcacaaggtcatggttcacgtgggcgggatggtgttctcgcctggctcggtgagtgtcatctcagacagcttgctgaccctgccagccatcgtcagcatcgcggccggcggcagcctcctcctcatcatcgtcatcatcgtcctcattgcctacaagcgcaagtctcgagaaaatgacctcactctcaagcggctgcaaatgcagatggacaatctggagtcccgtgtggccttggagtgcaaggaagcttttgctgagctccagacggatatcaatgagttgaccagtgacctggaccgctcaggaatcccttacctggactatcgtacctacgctatgcgagtcctgttcccgggcatcgaggaccaccccgtcctgcgggagctggaggtacaaggaaacgggcagcagcacgtggagaaggccctgaagctctttgcccagctcatcaacaacaaggtgttcctgctgaccttcatccgcaccctggagctgcagcgcagtttctccatgcgcgaccggggcaacgtggcttcgctcatcatgaccggcctgcagggccgcctggaatatgccactgatgtcctcaagcagctgctctctgacctcatcgataagaacctggagaacaagaaccaccccaagctgctactccggaggacagagtctgtggctgaaaagatgctgaccaattggttcgccttcctcctgcacaagttcctaaaggagtgcgcaggggagccactcttcatgctatactgtgccatcaagcagcagatggagaagggccccattgatgccatcacgggcgaggcccgctactccctgagcgaggacaagctcatccggcagcagatcgagtacaagaccctgatcctgaactgcgtcaaccctgacaacgagaacagtccagagatcccagtgaaggtgttaaactgtgacaccatcacacaggtcaaggagaagattcttgatgccgtgtataagaatgtgccctattcccagcggccgagggcagtggacatggacttggagtggcgccaaggccggatcgcccgggtcgtgctgcaagatgaggacatcaccaccaagattgagggtgactggaagcggctcaacacactgatgcattatcaggtgtcagacaggtcggtggtggctctggtccccaaacagacctcctcctacaacatccctgcctctgccagcatctcccggacgtccatcagcagatacgactcctccttcaggtatacgggcagccccgacagcctgcggtcccgggccccgatgatcaccccagacctggaaagtggggtcaaggtgtggcatctggtgaagaaccatgaccacggtgaccagaaggagggtgaccggggcagcaagatggtgtccgagatctacctgacccggctactggccaccaagggcaccctgcagaagtttgtggacgacttgtttgagaccttgttcagcactgtgcaccggggcagcgctctccccctggccatcaagtacatgtttgatttcctagatgagcaggcagacaggcacagcatccatgacacagatgtgcggcacacctggaaaagcaactgcctccctctgcgcttctgggtgaacgtgattaagaacccccagttcgtgtttgacatccacaagggcagcatcacggacgcctgcctctctgtggtggcccagaccttcatggactcttgttcaacgtcagagcaccggctgggcaaggactccccctccaacaagctgctctatgccaaggacatccccagctacaagagctgggtggagagatactacgcagacatcgccaagctcccagccatcagtgaccaggacatgaatgcctacctcgccgagcagtcccgcctgcacgccgtggagttcaacatgctgagtgccctcaatgagatctactcctatgtcagcaagtatagtgaggagctcatcggggccctagagcaggatgagcaggcacggcggcagcggctggcttataaggtggagcagctcattaatgccatgtccattgagagctgagaggaggagcctcgcattcctgggaagagggacctgtccaagctgtcacactgggagtctcagatggaaggacaagtgatggggatcaggccccagagcttgctgtcccctgagaccccatcctggggagaggggaggactcctctccctacgccagccaagtttcgtcatagccagttccagctgggagagacagtgggcgtcgtccatcctcagtgagaacaccagagaacccggggccgggagaaggtggttcttcaagccgagaggcacgagctggggacagttctgcctctgtgactgctgctttgcatgaaaactcatttgatgtatattggggaaataatgagaactttatttaatttttttaagaaaaagggaaaaaaacagaaataaaacaaaaagccgccctgttaatcccgtccaacttttgtttaattctgatttctgtctcccttccttcttttctcccattcctccttctttatataatgcctatttccaaatgccagagaaagcagagatgctgagagacattggagagaaaatgactgtctccttttccttgaaattaaaaaaaaaaaaaaaaagagagaaagaggagaagaagaatgatgagcacaagtatgcaccaaacacttcgcaaaaacagaggccagtaaaacctggaattatcccggcagccagaggagtatggaacttccagaactttgcacaaattgcaaagccatcaagagctcaccctggctggctggaaactgagctttatctaccacacacctgtatattctcatcttttgagaggagatgtgtacctagatagtaccaatgctttttgctactgttttttgttttgttttatttaatcctaaacctcaacaaatgaggagctggtctttgatatgtttcctttcaatttccctaaagttactatgagaagtggggtgaggtgggcctctcccagaccagacacctggcagccctgcctcatatcaatccctgtcataaaccaggcaccctggggaaacggcctggaggtgtgtgggccaggcctccacgaggttccatttgaaagttgatttggagacataggtgtttgactttggagttcactccaatcatccagtggtccctggcaattaaaaagaaaacaaaaatcaaacactgtttacagcaagcaatacttgaagagcataggttacagaagctgcagtatttattattatgctttctttctttcattctctcgtgcctggagaggggagaccacccttcgctcatatacggaagctcctgaccatctgggcctacagcacttcctcagtagaaatgactgtggcatgcccacgttactaccttctgcctctctttctgcctctcacggacttgtgagtgtgaaggacaagtggatgacttctcactggactttccttctctgtctcttctgatgatgcctaaaactatggataaccaattctcctgagtgtagattccaaacaaagagaccaaagctccatgcccaggtccaaaggccccatagaagccagtgggagtcatcgagaggaaaggcgctctgtgagtgtcaggaccttggtggccaggatagccatcagagtgtccaggcctcccacattaccttggatccgagcagccagctccaactgttctgcaagcagcactggagtcagggggtaggaggacaagtggaagcaaaggtgtgggactggggaagacaaagaggaacaagctgcccttcctcacttttcaaagggtcaggaatcctaggctatgatgctgggaagctagaccagctcctccaagagagactagaccagggtcattttctctgttattaactctgggctccagcttctccgtgccctgctttacctccaagtggttccaatttccaaaggccctgctgaccacatgtgattcccaggagagggctgggggaggggagcgcagaggtctggcttccatccttggcgtgtagctttggatcgctgtctaaccacacagcagacgttgcccggtctccccagctctagtttcttgcctgaatgcggctgacaaatgggaagagaaaagc

SEQ ID NO: 2351 - DNA, 5358 bp, Homo sapiens
aacaagaaaccctttctgggctggtagaaatcctgtaatgttgcctttagactgattatccactgaaggaactcttgtctgaaatagaaagatcccacagaatgccatggtcctgaggaacattaaaataaatagaaaatgagttcaggcacttagctttacaaattgatcctggttctcctggcagaaaggtagatacaggtgacgccagctgagtggaaggttgctgcctgttctttcatctggcttcataagaaccaacatggaatttgtgggtgagctggtgagaagtttttgtctgcagcttgtattagggcccctgaactcccatgtctgcctctctgaggcctgggtgtcctaaggctggaagttgtggatatgggtcgtgtagagacttcaccatgcctccactgttactcaccccaattccttccgcttccctccagcctgtccccatcgatgataacttctgtggactggacatcaaccagcccctgggaggctcaactccagtggagggcctgaccctgtacaccaccagcagggaccgcatgacctctgtggcctcctacgtttacaacggctacagcgtggtttttgtggggactaagagtggcaagctgaaaaagattcgggccgacggtcccccccatggtggggtccagtacgagatggtctctgtgctcaaggacggaagccccatcctccgggacatggccttctccattgatcagcgctacctgtacgtcatgtctgagagacaggtcaccagggtccccgtggagtcatgtgagcagtatacgacttgtggggagtgcctgagctctggggaccctcactgtggctggtgtgccctgcacaacatgtgctcccgcagggacaaatgccaacaggcctgggaacctaatcgatttgctgccagcatcagccagtgtgtgagccttgcagtgcatcccagcagcatctcagtatctgagcacagccggttgcttagcctggtagtgagtgatgctcctgatctatctgcgggtatcgcctgtgcctttgggaacctgacagaggtggaggggcaggtgtccgggagccaggtcatctgcatctcacctgggcccaaggatgtccctgtcatcccgctggatcaagactggtttgggctggagctacagctgaggtccaaggagacagggaagatatttgtcagcaccgagttcaagttttacaactgcagtgcccaccaactgtgcctgtcctgtgtcaacagcgccttccgctgccattggtgcaagtaccgcaacctctgcactcatgaccccaccacctgctccttccaggagggccggatcaatatttcagaggactgtccccagctggtgcccacagaggagatcttgattccagtcggggaggtaaagccaatcacccttaaggcgcgaaatctgccccagccgcagtccggccagcgaggctatgagtgtgtcctcaacatacaaggagccatccaccgggtccccgctctgcgcttcaacagctccagcgttcagtgtcagaacagctcgtaccagtatgatggcatggacatcagcaatctggccgtggatttcgctgtggtgtggaacggcaatttcatcattgacaaccctcaggacctgaaagtccatctctacaagtgtgcagcccagcgggagagctgcggcctctgcctcaaggccgaccggaagtttgagtgtggctggtgcagcggcgagcgcaggtgcaccctccaccagcactgtaccagcccttccagcccctggctcgactggtccagccacaatgtcaagtgctccaaccctcaaatcaccgagattttgacggtgtctggaccgccggaaggagggacgcgagtgaccatccatggcgtgaacctgggtctggacttctccgagatcgcccaccatgtgcaggtggctggggtgccctgcacgcccctcccaggggaatacatcatcgctgagcagattgtctgtgagatgggccatgccctcgtgggaaccacctccgggccagtacgcctgtgtattggcgagtgtaagccagagttcatgacgaagtcccatcagcagtacaccttcgtgaacccttctgtgctgtcactcaacccaatccgaggtcccgagtcaggaggcactatggtgaccattaccggccattaccttggggctgggagcagcgtggcagtctacctgggcaaccagacctgcgagttctacgggaggtcaatgagtgagatcgtgtgtgtctcacccccatcatccaatggccttggcccggtccctgtttctgtgagtgtcgaccgagcccatgtggatagcaacctgcagtttgagtacatagatgaccctcgggtccagcgcatcgagccagagtggagcattgccagtggccacacacccctgaccatcacaggcttcaacctggatgtcattcaggagccaaggatccgagtcaaattcaatggcaaagaatctgtcaatgtgtgtaaagttgtgaacacaaccaccctcacctgcctggcaccctctctgaccacggactaccgccctggcctggacactgtggaacgcccagatgagtttggatttgtctttaacaatgtccaatccttgctaatttacaacgacaccaagtttatctactaccccaacccgacctttgaactgcttagccctactggagtcttggatcaaaagccaggatcgcccatcattctgaagggcaaaaacctctgccctcctgcctctggaggggccaaactcaactacactgtgctcatcggagagaccccttgtgctgtcaccgtatctgagacccagcttctctgcgagcctcccaacctcaccgggcagcacaaggtcatggttcacgtgggcgggatggtgttctcgcctggctcggtgagtgtcatctcagacagcttgctgaccctgccagccatcgtcagcatcgcggccggcggcagcctcctcctcatcatcgtcatcatcgtcctcattgcctacaagcgcaagtctcgagaaaatgacctcactctcaagcggctgcaaatgcagatggacaatctggagtcccgtgtggccttggagtgcaaggaagcttttgctgagctccagacggatatcaatgagttgaccagtgacctggaccgctcaggaatcccttacctggactatcgtacctacgctatgcgagtcctgttcccgggcatcgaggaccaccccgtcctgcgggagctggaggtacaaggaaacgggcagcagcacgtggagaaggccctgaagctctttgcccagctcatcaacaacaaggtgttcctgctgaccttcatccgcaccctggagctgcagcgcagtttctccatgcgcgaccggggcaacgtggcttcgctcatcatgaccggcctgcagggccgcctggaatatgccactgatgtcctcaagcagctgctctctgacctcatcgataagaacctggagaacaagaaccaccccaagctgctactccggaggacagagtctgtggctgaaaagatgctgaccaattggttcgccttcctcctgcacaagttcctaaaggagtgcgcaggggagccactcttcatgctatactgtgccatcaagcagcagatggagaagggccccattgatgccatcacgggcgaggcccgctactccctgagcgaggacaagctcatccggcagcagatcgagtacaagaccctgatcctgaactgcgtcaaccctgacaacgagaacagtccagagatcccagtgaaggtgttaaactgtgacaccatcacacaggtcaaggagaagattcttgatgccgtgtataagaatgtgccctattcccagcggccgagggcagtggacatggacttggagtggcgccaaggccggatcgcccgggtcgtgctgcaagatgaggacatcaccaccaagattgagggtgactggaagcggctcaacacactgatgcattatcaggtgtcagacaggtcggtggtggctctggtccccaaacagacctcctcctacaacatccctgcctctgccagcatctcccggacgtccatcagcagatacgactcctccttcaggtatacgggcagccccgacagcctgcggtcccgggccccgatgatcaccccagacctggaaagtggggtcaaggtgtggcatctggtgaagaaccatgaccacggtgaccagaaggagggtgaccggggcagcaagatggtgtccgagatctacctgacccggctactggccaccaagggcaccctgcagaagtttgtggacgacttgtttgagaccttgttcagcactgtgcaccggggcagcgctctccccctggccatcaagtacatgtttgatttcctagatgagcaggcagacaggcacagcatccatgacacagatgtgcggcacacctggaaaagcaactgcctccctctgcgcttctgggtgaacgtgattaagaacccccagttcgtgtttgacatccacaagggcagcatcacggacgcctgcctctctgtggtggcccagaccttcatggactcttgttcaacgtcagagcaccggctgggcaaggactccccctccaacaagctgctctatgccaaggacatccccagctacaagagctgggtggagagatactacgcagacatcgccaagctcccagccatcagtgaccaggacatgaatgcctacctcgccgagcagtcccgcctgcacgccgtggagttcaacatgctgagtgccctcaatgagatctactcctatgtcagcaagtatagtgaggagctcatcggggccctagagcaggatgagcaggcacggcggcagcggctggcttataaggtggagcagctcattaatgccatgtccattgagagctgagaggaggagcctcgcattcctgggaagagggacctgtccaagctgtcacactgggagtctcagatggaaggacaagtgatggggatcaggccccagagcttgctgtcccctgagaccccatcctggggagaggggaggactcctctccctacgccagccaagtttcgtcatagccagttccagctgggagagacagtgggcgtcgtccatcctcagtgagaacaccagagaacccggggccgggagaaggtggttcttcaagccgagaggcacgagctggggacagttctgcctctgtgactgctgctttgcatgaaaactcatttgatgtatattggggaaataatgagaactttatttaatttttttaagaaaaagggaaaaaaacagaaataaaacaaaaagccgccctgtt

SEQ ID NO: 2352 - DNA, 9039 bp, Homo sapiens
  misc_feature (1857)..(1857): n is a, c, g, or t
  misc_feature (1864)..(1864): n is a, c, g, or t
ccgccgccaccggcgggagccagagctgccgggaggagcggcatccgcgccagactggagcgggagggcggcggagggcagttgctgggaatttttcagccgagagggcgagcgatccggagagagaccccgagagcttgggagcggtagggcgtgcgagcgccgcagccagcggagcaaacctcgaaatagatctggaaagccaggctcccggaggaaatgggactgtgaacgaaccggagagcaagaagggaaggaagcgccgggattgctgatgtcagaggagcccggaaagtcgcgctggaaaaatctgaagacagccggggctctgcttcttcctcaggagagacaccgccggccgcccccacacgccccctcggcgcctccgggtgccccctgagagccggcgacagcgcccagccgggctgctgcggggcgacggaggactgaggggcgcgcggagcggagaccgaggagcgacttcaggaatacagataagtgtctggtggcttgacgtggattttaatgaatttggactccatgtggatttggtcgtctccctgattccgagctgcgggcagggagaggggcctcgcgccgccctcagcagccggcggcggccgaggtagaccgagcggggacggaaggacagaccgacgtcgccgagctggaatcatgtgagggccaaccggggaaggtggagcagatgagcacacacaggagccgtctcctcaccgccgcccctctcagcatggaacagaggcagccctggccccgggccctggaggtggacagccgctctgtggtcctgctctcagtggtctgggtgctgctggcccccccagcagccggcatgcctcagttcagcaccttccactctgagaatcgtgactggaccttcaaccacttgaccgtccaccaagggacgggggccgtctatgtgggggccatcaaccgggtctataagctgacaggcaacctgaccatccaggtggctcataagacagggccagaagaggacaacaagtcttgttacccgcccctcatcgtgcagccctgcagcgaagtgctcaccctcaccaacaatgtcaacaagctgctcatcattgactactctgagaaccgcctgctggcctgtgggagcctctaccagggggtctgcaagctgctgcggctggatgacctcttcatcctggtggagccatcccacaagaaggagcactacctgtccagtgtcaacaagacgggcaccatgtacggggtgattgtgcgctctgagggtgaggatggcaagctcttcatcggcacggctgtggatgggaagcaggattacttcccgaccctgtccagccggaagctgccccgagaccctgagtcctcagccatgctcgactatgagctacacagcgattttgtctcctctctcatcaagatcccttcagacaccctggccctggtctcccactttgacatcttctacatctacggctttgctagtgggggctttgtctactttctcactgtccagcccgagacccctgagggtgtggccatcaactccgctggagacctcttctacacctcacgcatcgtgcggctctgcaaggatgaccccaagttccactcatacgtgtccctgcccttcggctgcacccgggccggggtggaataccgcctcctgcaggctgcttacctggccaagcctggggactcactggcccaggccttcaatatcaccagccaggacgatgtactctttgccatcttctccaaagggcagaagcagtatcaccacccgcccgatgactctgccctgtgtgccttccctatccgggccatcaacttgcagatcaaggngcgcctncagtcctgctaccagggcgagggcaacctggagctcaactggctgctggggaaggacgtccagtgcaccaaggcgcctgtccccatcgatgataacttctgtggactggacatcaaccagcccctgggaggctcaactccagtggagggcctgaccctgtacaccaccagcagggaccgcatgacctctgtggcctcctacgtttacaacggctacagcgtggtttttgtggggactaagagtggcaagctgaaaaagattcgggccgacggtcccccccatggtggggtccagtacgagatggtctctgtgctcaaggacggaagccccatcctccgggacatggccttctccattgatcagcgctacctgtacgtcatgtctgagagacaggtcaccagggtccccgtggagtcatgtgagcagtatacgacttgtggggagtgcctgagctctggggaccctcactgtggctggtgtgccctgcacaacatgtgctcccgcagggacaaatgccaacaggcctgggaacctaatcgatttgctgccagcatcagccagtgtgtgagccttgcagtgcatcccagcagcatctcagtatctgagcacagccggttgcttagcctggtagtgagtgatgctcctgatctatctgcgggtatcgcctgtgcctttgggaacctgacagaggtggaggggcaggtgtccgggagccaggtcatctgcatctcacctgggcccaaggatgtccctgtcatcccgctggatcaagactggtttgggctggagctacagctgaggtccaaggagacagggaagatatttgtcagcaccgagttcaagttttacaactgcagtgcccaccaactgtgcctgtcctgtgtcaacagcgccttccgctgccattggtgcaagtaccgcaacctctgcactcatgaccccaccacctgctccttccaggagggccggatcaatatttcagaggactgtccccagctggtgcccacagaggagatcttgattccagtcggggaggtaaagccaatcacccttaaggcgcgaaatctgccccagccgcagtccggccagcgaggctatgagtgtgtcctcaacatacaaggagccatccaccgggtccccgctctgcgcttcaacagctccagcgttcagtgtcagaacagctcgtaccagtatgatggcatggacatcagcaatctggccgtggatttcgctgtggtgtggaacggcaatttcatcattgacaaccctcaggacctgaaagtccatctctacaagtgtgcagcccagcgggagagctgcggcctctgcctcaaggccgaccggaagtttgagtgtggctggtgcagcggcgagcgcaggtgcaccctccaccagcactgtaccagcccttccagcccctggctcgactggtccagccacaatgtcaagtgctccaaccctcaaatcaccgagattttgacggtgtctggaccgccggaaggagggacgcgagtgaccatccatggcgtgaacctgggtctggacttctccgagatcgcccaccatgtgcaggtggctggggtgccctgcacgcccctcccaggggaatacatcatcgctgagcagattgtctgtgagatgggccatgccctcgtgggaaccacctccgggccagtacgcctgtgtattggcgagtgtaagccagagttcatgacgaagtcccatcagcagtacaccttcgtgaacccttctgtgctgtcactcaacccaatccgaggtcccgagtcaggaggcactatggtgaccattaccggccattaccttggggctgggagcagcgtggcagtctacctgggcaaccagacctgcgagttctacgggaggtcaatgagtgagatcgtgtgtgtctcacccccatcatccaatggccttggcccggtccctgtttctgtgagtgtcgaccgagcccatgtggatagcaacctgcagtttgagtacatagatgaccctcgggtccagcgcatcgagccagagtggagcattgccagtggccacacacccctgaccatcacaggcttcaacctggatgtcattcaggagccaaggatccgagtcaaattcaatggcaaagaatctgtcaatgtgtgtaaagttgtgaacacaaccaccctcacctgcctggcaccctctctgaccacggactaccgccctggcctggacactgtggaacgcccagatgagtttggatttgtctttaacaatgtccaatccttgctaatttacaacgacaccaagtttatctactaccccaacccgacctttgaactgcttagccctactggagtcttggatcaaaagccaggatcgcccatcattctgaagggcaaaaacctctgccctcctgcctctggaggggccaaactcaactacactgtgctcatcggagagaccccttgtgctgtcaccgtatctgagacccagcttctctgcgagcctcccaacctcaccgggcagcacaaggtcatggttcacgtgggcgggatggtgttctcgcctggctcggtgagtgtcatctcagacagcttgctgaccctgccagccatcgtcagcatcgcggccggcggcagcctcctcctcatcatcgtcatcatcgtcctcattgcctacaagcgcaagtctcgagaaaatgacctcactctcaagcggctgcaaatgcagatggacaatctggagtcccgtgtggccttggagtgcaaggaagcttttgctgagctccagacggatatcaatgagttgaccagtgacctggaccgctcaggaatcccttacctggactatcgtacctacgctatgcgagtcctgttcccgggcatcgaggaccaccccgtcctgcgggagctggaggtacaaggaaacgggcagcagcacgtggagaaggccctgaagctctttgcccagctcatcaacaacaaggtgttcctgctgaccttcatccgcaccctggagctgcagcgcagtttctccatgcgcgaccggggcaacgtggcttcgctcatcatgaccggcctgcagggccgcctggaatatgccactgatgtcctcaagcagctgctctctgacctcatcgataagaacctggagaacaagaaccaccccaagctgctactccggaggacagagtctgtggctgaaaagatgctgaccaattggttcgccttcctcctgcacaagttcctaaaggagtgcgcaggggagccactcttcatgctatactgtgccatcaagcagcagatggagaagggccccattgatgccatcacgggcgaggcccgctactccctgagcgaggacaagctcatccggcagcagatcgagtacaagaccctgatcctgaactgcgtcaaccctgacaacgagaacagtccagagatcccagtgaaggtgttaaactgtgacaccatcacacaggtcaaggagaagattcttgatgccgtgtataagaatgtgccctattcccagcggccgagggcagtggacatggacttggagtggcgccaaggccggatcgcccgggtcgtgctgcaagatgaggacatcaccaccaagattgagggtgactggaagcggctcaacacactgatgcattatcaggtgtcagacaggtcggtggtggctctggtccccaaacagacctcctcctacaacatccctgcctctgccagcatctcccggacgtccatcagcagatacgactcctccttcaggtatacgggcagccccgacagcctgcggtcccgggccccgatgatcaccccagacctggaaagtggggtcaaggtgtggcatctggtgaagaaccatgaccacggtgaccagaaggagggtgaccggggcagcaagatggtgtccgagatctacctgacccggctactggccaccaagggcaccctgcagaagtttgtggacgacttgtttgagaccttgttcagcactgtgcaccggggcagcgctctccccctggccatcaagtacatgtttgatttcctagatgagcaggcagacaggcacagcatccatgacacagatgtgcggcacacctggaaaagcaactgcctccctctgcgcttctgggtgaacgtgattaagaacccccagttcgtgtttgacatccacaagggcagcatcacggacgcctgcctctctgtggtggcccagaccttcatggactcttgttcaacgtcagagcaccggctgggcaaggactccccctccaacaagctgctctatgccaaggacatccccagctacaagagctgggtggagagatactacgcagacatcgccaagctcccagccatcagtgaccaggacatgaatgcctacctcgccgagcacaggatgagcaggcacggcggcagcggctggcttataaggtggagcagctcattaatgccatgtccattgagagctgagaggaggagcctcgcattcctgggaagagggacctgtccaagctgtcacactgggagtctcagatggaaggacaagtgatggggatcaggccccagagcttgctgtcccctgagaccccatcctggggagaggggaggactcctctccctacgccagccaagtttcgtcatagccagttccagctgggagagacagtgggcgtcgtccatcctcagtgagaacaccagagaacccggggccgggagaaggtggttcttcaagccgagaggcacgagctggggacagttctgcctctgtgactgctgctttgcatgaaaactcatttgatgtatattggggaaataatgagaactttatttaatttttttaagaaaaagggaaaaaaacagaaataaaacaaaaagccgccctgttaatcccgtccaacttttgtttaattctgatttctgtctcccttccttcttttctcccattcctccttctttatataatgcctatttccaaatgccagagaaagcagagatgctgagagacattggagagaaaatgactgtctccttttccttgaaattaaaaaaaaaaaaaaaaagagagaaagaggagaagaagaatgatgagcacaagtatgcaccaaacacttcgcaaaaacagaggccagtaaaacctggaattatcccggcagccagaggagtatggaacttccagaactttgcacaaattgcaaagccatcaagagctcaccctggctggctggaaactgagctttatctaccacacacctgtatattctcatcttttgagaggagatgtgtacctagatagtaccaatgctttttgctactgttttttgttttgttttatttaatcctaaacctcaacaaatgaggagctggtctttgatatgtttcctttcaatttccctaaagttactatgagaagtggggtgaggtgggcctctcccagaccagacacctggcagccctgcctcatatcaatccctgtcataaaccaggcaccctggggaaacggcctggaggtgtgtgggccaggcctccacgaggttccatttgaaagttgatttggagacataggtgtttgactttggagttcactccaatcatccagtggtccctggcaattaaaaagaaaacaaaaatcaaacactgtttacagcaagcaatacttgaagagcataggttacagaagctgcagtatttattattatgctttctttctttcattctctcgtgcctggagaggggagaccacccttcgctcatatacggaagctcctgaccatctgggcctacagcacttcctcagtagaaatgactgtggcatgcccacgttactaccttctgcctctctttctgcctctcacggacttgtgagtgtgaaggacaagtggatgacttctcactggactttccttctctgtctcttctgatgatgcctaaaactatggataaccaattccctggccctgctgagcgtgaaacagaagcaatggatgagtgctggacgaagaatggcctgggcagaacaaatagggagcatttgaaagcttctggctgataaatctccaggtgcatcccggttgccacgcctgcccccattaacctgctcctggtaaatactgatccagcagctgctccaggagaggccgtctttttttcccagccacgctgtgtcttgcatgagactcctggggcctgggcacagagagaaaagaattgagactcaggaggctcagtgggtgagaaaatgcaaagtggcttcacagacacagggctgtgggagcagatcgacggggaacttgggagatgaacttcagggccttccgacgccttgtctcaggaacatgctttgagaaaaatggtagcatcctttccataactcagtctctcttccctagtttccctgaagtgtgacgttttagtatctggagctcagtgatccccatgaatgagggataaagtttcactcttggtattttctaactagtgctagggaaagtcctgagacacgatcacagccactgcttggcatacagggcctccacccaataagcaaactggagattcctcagcctctcgtggacacccacatctcattcttctcacagcagagaagctctcccttcagcctgagctgtcttctttctgctgcagtgcagcctgctccctcctaccctggcctcaaggaaggtgggaaacatcttctgcatttcaaagtcctcactttgacttatttggccttcatcttggcatggaaggtggcaggcagaatggaaatactccccccaaacagaacagatattcttgcgtgtgtaagggcagaagggacaagctctctatcccatgagactaggggccggagcccacctgcctttccccacaacttttcctgctcaaacccactcctcttgacacactggaatctgtattatatatatttttaagaaaatacaatgatggttgtctggttttgttgtttttacaggtgttgtggaataaaaactgtaagaaaattaagtatttaaaatgttccaataaagtggggttttttgttattctaatatattattgtgtacctattgtaaatatgaaacactcctattttgcaagctgaggacacaatttgtactgttgttatatataaataaagtttactgaattaaaaaaaccttaaatctttaaata

SEQ ID NO: 2353 - DNA, 3329 bp, Homo sapiens
ccaacagctttggctaaattaaccctggctggacccattttcttccattttactcctttgccccttcaggtggacaatttgacctttgatggggaagaatatcagtgggcagcagaaggggcacggcccgcatgcattctcaagtcttctctgcctttccccacagcctccctctgcgcttctgggtgaacgtgattaagaacccccagttcgtgtttgacatccacaagggcagcatcacggacgcctgcctctctgtggtggcccagaccttcatggactcttgttcaacgtcagagcaccggctgggcaaggactccccctccaacaagctgctctatgccaaggacatccccagctacaagagctgggtggagagatactacgcagacatcgccaagctcccagccatcagtgaccaggacatgaatgcctacctcgccgagcagtcccgcctgcacgccgtggagttcaacatgctgagtgccctcaatgagatctactcctatgtcagcaagtatagtgaggagctcatcggggccctagagcaggatgagcaggcacggcggcagcggctggcttataaggtggagcagctcattaatgccatgtccattgagagctgagaggaggagcctcgcattcctgggaagagggacctgtccaagctgtcacactgggagtctcagatggaaggacaagtgatggggatcaggccccagagcttgctgtcccctgagaccccatcctggggagaggggaggactcctctccctacgccagccaagtttcgtcatagccagttccagctgggagagacagtgggcgtcgtccatcctcagtgagaacaccagagaacccggggccgggagaaggtggttcttcaagccgagaggcacgagctggggacagttctgcctctgtgactgctgctttgcatgaaaactcatttgatgtatattggggaaataatgagaactttatttaatttttttaagaaaaagggaaaaaaacagaaataaaacaaaaagccgccctgttaatcccgtccaacttttgtttaattctgatttctgtctcccttccttcttttctcccattcctccttctttatataatgcctatttccaaatgccagagaaagcagagatgctgagagacattggagagaaaatgactgtctccttttccttgaaattaaaaaaaaaaaaaaaaagagagaaagaggagaagaagaatgatgagcacaagtatgcaccaaacacttcgcaaaaacagaggccagtaaaacctggaattatcccggcagccagaggagtatggaacttccagaactttgcacaaattgcaaagccatcaagagctcaccctggctggctggaaactgagctttatctaccacacacctgtatattctcatcttttgagaggagatgtgtacctagatagtaccaatgctttttgctactgttttttgttttgttttatttaatcctaaacctcaacaaatgaggagctggtctttgatatgtttcctttcaatttccctaaagttactatgagaagtggggtgaggtgggcctctcccagaccagacacctggcagccctgcctcatatcaatccctgtcataaaccaggcaccctggggaaacggcctggaggtgtgtgggccaggcctccacgaggttccatttgaaagttgatttggagacataggtgtttgactttggagttcactccaatcatccagtggtccctggcaattaaaaagaaaacaaaaatcaaacactgtttacagcaagcaatacttgaagagcataggttacagaagctgcagtatttattattatgctttctttctttcattctctcgtgcctggagaggggagaccacccttcgctcatatacggaagctcctgaccatctgggcctacagcacttcctcagtagaaatgactgtggcatgcccacgttactaccttctgcctctctttctgcctctcacggacttgtgagtgtgaaggacaagtggatgacttctcactggactttccttctctgtctcttctgatgatgcctaaaactatggataaccaattccctggccctgctgagcgtgaaacagaagcaatggatgagtgctggacgaagaatggcctgggcagaacaaatagggagcatttgaaagcttctggctgataaatctccaggtgcatcccggttgccacgcctgcccccattaacctgctcctggtaaatactgatccagcagctgctccaggagaggccgtctttttttcccagccacgctgtgtcttgcatgagactcctggggcctgggcacagagagaaaagaattgagactcaggaggctcagtgggtgagaaaatgcaaagtggcttcacagacacagggctgtgggagcagatcgacggggaacttgggagatgaacttcagggccttccgacgccttgtctcaggaacatgctttgagaaaaatggtagcatcctttccataactcagtctctcttccctagtttccctgaagtgtgacgttttagtatctggagctcagtgatccccatgaatgagggataaagtttcactcttggtattttctaactagtgctagggaaagtcctgagacacgatcacagccactgcttggcatacagggcctccacccaataagcaaactggagattcctcagcctctcgtggacacccacatctcattcttctcacagcagagaagctctcccttcagcctgagctgtcttctttctgctgcagtgcagcctgctccctcctaccctggcctcaaggaaggtgggaaacatcttctgcatttcaaagtcctcactttgacttatttggccttcatcttggcatggaaggtggcaggcagaatggaaatactccccccaaacagaacagatattcttgcgtgtgtaagggcagaagggacaagctctctatcccatgagactaggggccggagcccacctgcctttccccacaacttttcctgctcaaacccactcctcttgacacactggaatctgtattatatatatttttaagaaaatacaatgatggttgtctggttttgttgtttttacaggtgttgtggaataaaaactgtaagaaaattaagtatttaaaatgttccaataaagtggggttttttgttattctaatatattattgtgtacctattgtaaatatgaaacactcctattttgcaagctgaggacacaatttgtactgttgttatatataaataaagtttactgaattaaaaaaaccttaaatctttaaata

SEQ ID NO: 2354 - DNA, 3790 bp, Homo sapiens
gtatagtattgtgctctatcccctacgtctcccgcgggcatgctggtcctactggaccttggagtggcgccaaggccggatcgcccgggtcgtgctgcaagatgaggacatcaccaccaagattgagggtgactggaagcggctcaacacactgatgcattatcaggtgtcagacaggtcggtggtggctctggtccccaaacagacctcctcctacaacatccctgcctctgccagcatctcccggacgtccatcagcagatacgactcctccttcaggtatacgggcagccccgacagcctgcggtcccgggccccgatgatcaccccagacctggaaagtggggtcaaggtgtggcatctggtgaagaaccatgaccacggtgaccagaaggagggtgaccggggcagcaagatggtgtccgagatctacctgacccggctactggccaccaagggcaccctgcagaagtttgtggacgacttgtttgagaccttgttcagcactgtgcaccggggcagcgctctccccctggccatcaagtacatgtttgatttcctagatgagcaggcagacaggcacagcatccatgacacagatgtgcggcacacctggaaaagcaactgcctccctctgcgcttctgggtgaacgtgattaagaacccccagttcgtgtttgacatccacaagggcagcatcacggacgcctgcctctctgtggtggcccagaccttcatggactcttgttcaacgtcagagcaccggctgggcaaggactccccctccaacaagctgctctatgccaaggacatccccagctacaagagctgggtggagagatactacgcagacatcgccaagctcccagccatcagtgaccaggacatgaatgcctacctcgccgagcagtcccgcctgcacgccgtggagttcaacatgctgagtgccctcaatgagatctactcctatgtcagcaagtatagtgaggagctcatcggggccctagagcaggatgagcaggcacggcggcagcggctggcttataaggtggagcagctcattaatgccatgtccattgagagctgagaggaggagcctcgcattcctgggaagagggacctgtccaagctgtcacactgggagtctcagatggaaggacaagtgatggggatcaggccccagagcttgctgtcccctgagaccccatcctggggagaggggaggactcctctccctacgccagccaagtttcgtcatagccagttccagctgggagagacagtgggcgtcgtccatcctcagtgagaacaccagagaacccggggccgggagaaggtggttcttcaagccgagaggcacgagctggggacagttctgcctctgtgactgctgctttgcatgaaaactcatttgatgtatattggggaaataatgagaactttatttaatttttttaagaaaaagggaaaaaaacagaaataaaacaaaaagccgccctgttaatcccgtccaacttttgtttaattctgatttctgtctcccttccttcttttctcccattcctccttctttatataatgcctatttccaaatgccagagaaagcagagatgctgagagacattggagagaaaatgactgtctccttttccttgaaattaaaaaaaaaaaaaaaaagagagaaagaggagaagaagaatgatgagcacaagtatgcaccaaacacttcgcaaaaacagaggccagtaaaacctggaattatcccggcagccagaggagtatggaacttccagaactttgcacaaattgcaaagccatcaagagctcaccctggctggctggaaactgagctttatctaccacacacctgtatattctcatcttttgagaggagatgtgtacctagatagtaccaatgctttttgctactgttttttgttttgttttatttaatcctaaacctcaacaaatgaggagctggtctttgatatgtttcctttcaatttccctaaagttactatgagaagtggggtgaggtgggcctctcccagaccagacacctggcagccctgcctcatatcaatccctgtcataaaccaggcaccctggggaaacggcctggaggtgtgtgggccaggcctccacgaggttccatttgaaagttgatttggagacataggtgtttgactttggagttcactccaatcatccagtggtccctggcaattaaaaagaaaacaaaaatcaaacactgtttacagcaagcaatacttgaagagcataggttacagaagctgcagtatttattattatgctttctttctttcattctctcgtgcctggagaggggagaccacccttcgctcatatacggaagctcctgaccatctgggcctacagcacttcctcagtagaaatgactgtggcatgcccacgttactaccttctgcctctctttctgcctctcacggacttgtgagtgtgaaggacaagtggatgacttctcactggactttccttctctgtctcttctgatgatgcctaaaactatggataaccaattccctggccctgctgagcgtgaaacagaagcaatggatgagtgctggacgaagaatggcctgggcagaacaaatagggagcatttgaaagcttctggctgataaatctccaggtgcatcccggttgccacgcctgcccccattaacctgctcctggtaaatactgatccagcagctgctccaggagaggccgtctttttttcccagccacgctgtgtcttgcatgagactcctggggcctgggcacagagagaaaagaattgagactcaggaggctcagtgggtgagaaaatgcaaagtggcttcacagacacagggctgtgggagcagatcgacggggaacttgggagatgaacttcagggccttccgacgccttgtctcaggaacatgctttgagaaaaatggtagcatcctttccataactcagtctctcttccctagtttccctgaagtgtgacgttttagtatctggagctcagtgatccccatgaatgagggataaagtttcactcttggtattttctaactagtgctagggaaagtcctgagacacgatcacagccactgcttggcatacagggcctccacccaataagcaaactggagattcctcagcctctcgtggacacccacatctcattcttctcacagcagagaagctctcccttcagcctgagctgtcttctttctgctgcagtgcagcctgctccctcctaccctggcctcaaggaaggtgggaaacatcttctgcatttcaaagtcctcactttgacttatttggccttcatcttggcatggaaggtggcaggcagaatggaaatactccccccaaacagaacagatattcttgcgtgtgtaagggcagaagggacaagctctctatcccatgagactaggggccggagcccacctgcctttccccacaacttttcctgctcaaacccactcctcttgacacactggaatctgtattatatatatttttaagaaaatacaatgatggttgtctggttttgttgtttttacaggtgttgtggaataaaaactgtaagaaaattaagtatttaaaatgttccaataaagtggggttttttgttattctaatatattattgtgtacctattgtaaatatgaaacactcctattttgcaagctgaggacacaatttgtactgttgttatatataaataaagtttactgaattaaaaaaaccttaaatctttaaata

SEQ ID NO: 2355 - DNA, 3143 bp, Homo sapiens
  misc_feature (162)..(162): n is a, c, g, or t
gggcagacatcaaggcagcgccatgcctcctctgtgcgtgcgaccacacccctcagtgaacgtcttgctacaacgtgcagaggcagcgaggtgtccccttgattccctcctcctaacaaggctgctcttatgcgcaacgtgacatttcccagtctactaagnagcttgagtgtgtggagatgatacgtacagcatagatcggaacgaagcttcctcagcccgatctacgtgaccaggacatgaatgcctacctcgccgagcagtcccgcctgcacgccgtggagttcaacatgctgagtgccctcaatgagatctactcctatgtcagcaagtatagtgaggagctcatcggggccctagagcaggatgagcaggcacggcggcagcggctggcttataaggtggagcagctcattaatgccatgtccattgagagctgagaggaggagcctcgcattcctgggaagagggacctgtccaagctgtcacactgggagtctcagatggaaggacaagtgatggggatcaggccccagagcttgctgtcccctgagaccccatcctggggagaggggaggactcctctccctacgccagccaagtttcgtcatagccagttccagctgggagagacagtgggcgtcgtccatcctcagtgagaacaccagagaacccggggccgggagaaggtggttcttcaagccgagaggcacgagctggggacagttctgcctctgtgactgctgctttgcatgaaaactcatttgatgtatattggggaaataatgagaactttatttaatttttttaagaaaaagggaaaaaaacagaaataaaacaaaaagccgccctgttaatcccgtccaacttttgtttaattctgatttctgtctcccttccttcttttctcccattcctccttctttatataatgcctatttccaaatgccagagaaagcagagatgctgagagacattggagagaaaatgactgtctccttttccttgaaattaaaaaaaaaaaaaaaaagagagaaagaggagaagaagaatgatgagcacaagtatgcaccaaacacttcgcaaaaacagaggccagtaaaacctggaattatcccggcagccagaggagtatggaacttccagaactttgcacaaattgcaaagccatcaagagctcaccctggctggctggaaactgagctttatctaccacacacctgtatattctcatcttttgagaggagatgtgtacctagatagtaccaatgctttttgctactgttttttgttttgttttatttaatcctaaacctcaacaaatgaggagctggtctttgatatgtttcctttcaatttccctaaagttactatgagaagtggggtgaggtgggcctctcccagaccagacacctggcagccctgcctcatatcaatccctgtcataaaccaggcaccctggggaaacggcctggaggtgtgtgggccaggcctccacgaggttccatttgaaagttgatttggagacataggtgtttgactttggagttcactccaatcatccagtggtccctggcaattaaaaagaaaacaaaaatcaaacactgtttacagcaagcaatacttgaagagcataggttacagaagctgcagtatttattattatgctttctttctttcattctctcgtgcctggagaggggagaccacccttcgctcatatacggaagctcctgaccatctgggcctacagcacttcctcagtagaaatgactgtggcatgcccacgttactaccttctgcctctctttctgcctctcacggacttgtgagtgtgaaggacaagtggatgacttctcactggactttccttctctgtctcttctgatgatgcctaaaactatggataaccaattccctggccctgctgagcgtgaaacagaagcaatggatgagtgctggacgaagaatggcctgggcagaacaaatagggagcatttgaaagcttctggctgataaatctccaggtgcatcccggttgccacgcctgcccccattaacctgctcctggtaaatactgatccagcagctgctccaggagaggccgtctttttttcccagccacgctgtgtcttgcatgagactcctggggcctgggcacagagagaaaagaattgagactcaggaggctcagtgggtgagaaaatgcaaagtggcttcacagacacagggctgtgggagcagatcgacggggaacttgggagatgaacttcagggccttccgacgccttgtctcaggaacatgctttgagaaaaatggtagcatcctttccataactcagtctctcttccctagtttccctgaagtgtgacgttttagtatctggagctcagtgatccccatgaatgagggataaagtttcactcttggtattttctaactagtgctagggaaagtcctgagacacgatcacagccactgcttggcatacagggcctccacccaataagcaaactggagattcctcagcctctcgtggacacccacatctcattcttctcacagcagagaagctctcccttcagcctgagctgtcttctttctgctgcagtgcagcctgctccctcctaccctggcctcaaggaaggtgggaaacatcttctgcatttcaaagtcctcactttgacttatttggccttcatcttggcatggaaggtggcaggcagaatggaaatactccccccaaacagaacagatattcttgcgtgtgtaagggcagaagggacaagctctctatcccatgagactaggggccggagcccacctgcctttccccacaacttttcctgctcaaacccactcctcttgacacactggaatctgtattatatatatttttaagaaaatacaatgatggttgtctggttttgttgtttttacaggtgttgtggaataaaaactgtaagaaaattaagtatttaaaatgttccaataaagtggggttttttgttattctaatatattattgtgtacctattgtaaatatgaaacactcctattttgcaagctgaggacacaatttgtactgttgttatatataaataaagtttactgaattaaaaaaaccttaaatctttaaata

SEQ ID NO: 2356 - DNA, 2392 bp, Homo sapiens
  misc_feature (1857)..(1857): n is a, c, g, or t
  misc_feature (1864)..(1864): n is a, c, g, or t
ccgccgccaccggcgggagccagagctgccgggaggagcggcatccgcgccagactggagcgggagggcggcggagggcagttgctgggaatttttcagccgagagggcgagcgatccggagagagaccccgagagcttgggagcggtagggcgtgcgagcgccgcagccagcggagcaaacctcgaaatagatctggaaagccaggctcccggaggaaatgggactgtgaacgaaccggagagcaagaagggaaggaagcgccgggattgctgatgtcagaggagcccggaaagtcgcgctggaaaaatctgaagacagccggggctctgcttcttcctcaggagagacaccgccggccgcccccacacgccccctcggcgcctccgggtgccccctgagagccggcgacagcgcccagccgggctgctgcggggcgacggaggactgaggggcgcgcggagcggagaccgaggagcgacttcaggaatacagataagtgtctggtggcttgacgtggattttaatgaatttggactccatgtggatttggtcgtctccctgattccgagctgcgggcagggagaggggcctcgcgccgccctcagcagccggcggcggccgaggtagaccgagcggggacggaaggacagaccgacgtcgccgagctggaatcatgtgagggccaaccggggaaggtggagcagatgagcacacacaggagccgtctcctcaccgccgcccctctcagcatggaacagaggcagccctggccccgggccctggaggtggacagccgctctgtggtcctgctctcagtggtctgggtgctgctggcccccccagcagccggcatgcctcagttcagcaccttccactctgagaatcgtgactggaccttcaaccacttgaccgtccaccaagggacgggggccgtctatgtgggggccatcaaccgggtctataagctgacaggcaacctgaccatccaggtggctcataagacagggccagaagaggacaacaagtcttgttacccgcccctcatcgtgcagccctgcagcgaagtgctcaccctcaccaacaatgtcaacaagctgctcatcattgactactctgagaaccgcctgctggcctgtgggagcctctaccagggggtctgcaagctgctgcggctggatgacctcttcatcctggtggagccatcccacaagaaggagcactacctgtccagtgtcaacaagacgggcaccatgtacggggtgattgtgcgctctgagggtgaggatggcaagctcttcatcggcacggctgtggatgggaagcaggattacttcccgaccctgtccagccggaagctgccccgagaccctgagtcctcagccatgctcgactatgagctacacagcgattttgtctcctctctcatcaagatcccttcagacaccctggccctggtctcccactttgacatcttctacatctacggctttgctagtgggggctttgtctactttctcactgtccagcccgagacccctgagggtgtggccatcaactccgctggagacctcttctacacctcacgcatcgtgcggctctgcaaggatgaccccaagttccactcatacgtgtccctgcccttcggctgcacccgggccggggtggaataccgcctcctgcaggctgcttacctggccaagcctggggactcactggcccaggccttcaatatcaccagccaggacgatgtactctttgccatcttctccaaagggcagaagcagtatcaccacccgcccgatgactctgccctgtgtgccttccctatccgggccatcaacttgcagatcaaggngcgcctncagtcctgctaccagggcgagggcaacctggagctcaactggctgctggggaaggacgtccagtgcaccaaggcgcctgtccccatcgatgataacttctgtggactggacatcaaccagcccctgggaggctcaactccagtggagggcctgaccctgtacaccaccagcagggaccgcatgacctctgtggcctcctacgtttacaacggctacagcgtggtttttgtggggactaagagtggcaagctgaaaaaggtaagagtctatgagttcagatgctccaatgccattcacctcctcagcaaagagtccctcttggaaggtagctattggtggagatttaactataggcaactttattttcttggggaacaaaggtgaaatggggaggtaagaaggggttaattttgtgacttagcttctagctacttcctccagccatcagtcattgggtatgtaaggaatgcaagcgtatttcaatatttcccaaactttaagaaaaaactttaagaaggtacatctgca

SEQ ID NO: 2357 - DNA, 201 bp, Homo sapiens
acaaaaaggatggccatgggtgcaacaggggccctgactgcgggttgtactgaacggcaaacatatcgcagttcttgcttttagggaataaagtagggagaggaagaggaggtagagtctccagcagtgacttcaacagctcgctgtcttcactatctaggaaataggtgtaaaaacctgctcaaaacgaaatagatttgt

SEQ ID NO: 2358 - DNA, 317 bp, Homo sapiens
ttcttcttctttttttttttttgagacagttttgctcttgttgcccagactggagagcaatggcgtgatctcggctcactgcaacctccgcctcctgtgttcaagcgattctcctgcctcagcctcctgagtagctgggattacaggcgcccgccaccgtgcccagctagctctcatttctcttgaaatataattgtcatgtgagtttcttcaatccaaacaattggaaacgatagccattggtagacactttgtttcctgtccaagacaagaaacaattagcctctaacaagctctttgacctagaacttaatctt

SEQ ID NO: 2359 - DNA, 245 bp, Homo sapiens
ggcatgcctgttaatttttattgaaaagtgggcattgtatataaaaaaattgtagcgaccctagatgattttctaatatctagatggcttacaccatttgctaggcaaatagaatgggggctgattccatttatcttgtctgagctgaccacagcaagggcgtggttttggtcaggctccatctctttttggtttgcctctactctttggaagtaccctgcaggagttctggctaagaactgggg

SEQ ID NO: 2360 - DNA, 835 bp, Homo sapiens
atggagtttctccatgttggtcaggctggtctcgaactcctgatctcaggtgatccacccgccttggcctcccaaagtgctgggattacaggcgtgagccaccgtgcgcggcgcatgtgtttgttttcatagctgtgaagacagcaacaggcaggtgagagagtctggtctcgtccctccctcacttgtgacctcagaccagccattgccctcactgggcctcagttactccaactttatagtggggggttggatccaacaattttgaagagctctctcttaatctctgacataatgagtctgaaacaaagaaaagttaccttaccgtgtctttacttcctttcttctgggctgtgaactcaagtgccttgagggccagctaagagctttttgggatatttgtctaacttaattgaactgttactgaaagataaattaacaaaatggttcagagttttggattaagacctttgtaactaactgaccgtcagcacaggagcttcggtttccttctctgtaaaacagggctcctcattccaattccacctatcctgtagccttgtgggaataaaaggaggcaccacatcccttgcccccacagggctttgaaaaaccagagtgctgggatttgcccaaggtgagtcagggtcactaccttcctgctgcctttggccgttcccaggataaaactcccctggttgagtgagatggaaacctaaaatgaaaccttgctagagtcccggactcaagcctcattactgtcacctttgtcagcagccgcagcgccaaatctatcgtcaccatcatcacttctccctgaggcctggtatcccgt

SEQ ID NO: 2361 - DNA, 608 bp, Homo sapiens
atggagtttctccatgttggtcaggctggtctcgaactcctgatctcaggtgatccacccgccttggcctcccaaagtgctgggattacaggcgtgagccaccgtgcgcggcgcatgtgtttgttttcatagctgtgaagacagcaacaggcaggtgagagagtctggtctcgtccctccctcacttgtgacctcagaccagccattgccctcactgggcctcagttactccaactttatagtggggggttggatccaacaattttgaagagctctctcttaatctctgacataatgagtctgaaacaaagaaaagttaccttaccgtgtctttacttcctttcttctgggctgtgaactcaagtgccttgagggccagctaagagctttttgggatatttgtctaacttaattgaactgttactgaaagataaattaacaaaatggttcagagttttggattaagacctttgtaactaactgaccgtcagcacaggagcttcggtttccttctctgtaaaacagggctcctcattccaattccacctatcctgtagccttgtgggaataaaaggaggcaccacgtggaggtgcttggcagggtgaaa

SEQ ID NO: 2362 - DNA, 596 bp, Homo sapiens
gttgttgtgtaagcccatcagaggaggacaaccaaccaggctgtgtggagggcagacttcgagcccaacagccctgacttgaactctgatcctacttggcatcctattctgggagacaagactagctccttggagaaccaggcagtaaatgagatcaagccttggaaaacgagtgaagtccccggggaaggctttctggatacggtgaggcgcacagcgagtgaaatttaaagaggtagcagagaaaaattgattctccttcaaaagtatggatcccattctgttcacttttccaggagcattctagaaactggtggtgaaggggttaactgtgccagctaccacatcccttgcccccacagggctttgaaaaaccagagtgctgggatttgcccaaggtgagtcagggtcactaccttcctgctgcctttggccgttcccaggataaaactcccctggttgagtgagatggaaacctaaaatgaaaccttgctagagtcccggactcaagcctcattactgtcacctttgtcagcagccgcagcgccaaatctatcgtcaccatcatcacttctccctgaggcctggtatcccgt

SEQ ID NO: 2363 - DNA, 428 bp, Homo sapiens
tgtatagggcagctgatagagtgccagtggcccagcatctggggggtggttagtagtgatcatgagctcatcaggggcaaagcccagggggtccatctgtacctgttttgcccatcagataccaattgggaactttatcttctcttgaaaccatagcctataaccaggtcaccatgattaatgtgcatataattagcaaagtacagagaagccatagaaattccctgtgagaagatgcaaaactcagtgtgggaaagcagagtcctcaggaatacacggaagtgggaggaacccggggcttacctcacacatcttggccatagccgggaatatcacaggcaggccgacaactgtgtgacaaagggctgtcttctaatcacacaaccaaatggcaggagaaccaccctttctccatcgcctgctttaaa

SEQ ID NO: 2364 - DNA, 330 bp, Homo sapiens
gttcggtaggttagatgtgtttgatgcattttcagcttagggtattttcaacttacagaacatttatcaggaagtaaccccatcgtaagttgattagtatctctacttgaaattgagattatggaagcaatgcagttagtaatgaaaaggtaaaggtgttgtcatggagttgacttccgaggtagtaaagaaaggataaggccagacatggtgggtcacacctgtaattccagcactttgggaggctgaggtgggaggattgcttgaggccaggagtttgagaccagcctgggcaacagcgagaccccatctctgtttttaaaataaaaa

SEQ ID NO: 2365 - DNA, 429 bp, Homo sapiens
ctcatgaatttgttgaatgaagaaattcgttttaaaaatttattttctttgcttccttcattgtctggccttcctactttggttaatgcttatgttttcctgagccttactaacacgaggccgctcttaaaaaagagagagcgctgggtgctgtggctcacgcctgtaatcccagtactttgggaggccgaggtgggcagatcacctgaggtcaggagttcgagaccagcctgaccaccatggtgaaaccccatctctagtaaaaatgcaaaattagccagttgtggtggcgcatgcctgtaatcccagctactcgggaggctgaggcaggagaatcacttgaacccgggaggtggaggttgcagttagctgagatcgcagcattgcattccagcctggacaacaaaagcgaaactccatctcaaaaaa

SEQ ID NO: 2366 - DNA, 1858 bp, Homo sapiens
  misc_feature (1253)..(1253): n is a, c, g, or t
gagtaaacttttctctgcttctagaaaactgacttctcaatctctggaagttggaggttttgttgtggcaatttgcttgtgttgttttttaatgtggactgcgagaaacaggggcagttgaggtcatgttgaaatctgctgtggttggttctgatgtgctttctagtatgttctttctttagtgggaccaacagggttataataccttcctctgagttggaagataggcgcttctgacttattgccaagctcgggtaactgagctggactgcctctttttcttctctttccccccacatatgtgtgcatatctaaggtgaccacctatagaccgcatgattcctggtgactcaaggatgagggtgggagcaacagtaccagtggggggtggtaatgtggtcagctctgcaataagtgaaaaagcagacaagaaaatatgcagggaaagactgtgagtaggactggagtctcttttgattggtacaggttcttattgacaaaaagcatgtcatgatatatcctaggaaaaatacttgaatttagcatgaacttttccgtgagtggttcctcaaaaattttcaagagtagaagaacagcagtggactggcagatgcagatgttgtacaggaagaagaaccccctgctcaaaatactatccagtgagcctcaggatatatttttttttaaattttgcttccttgaaggagtaagatacttacaaaaagatgcatctagaaaacaaaaataaactctgaaatttaaaatgtgatatcagaagtgtacaacctaatagacaggttagaagataaaactgagaaagtctcaccaaaaaacaaagtaatggtaagtcggggacaggagataaaagaattagaggacctgtccaggatgtccaatatttgaataatgggagttctaaaaagagtgaacaagggaaacaaaaggtaattattcgagaaaatatccctgcactgaagaatgggagtttctgcactgaaagggccagagatggtagctgcaaagagacacatcgagagctttaagaggtgaaagttttggcctctgtgcagaggaagtggtagggacaggtctcctcttggcttcctttaaacaagccctgaagaatattcaactcttcaaattattgcatgtataacgatttaaaaaacaaaaactttggtaaggttgaaaaataaaagacatcaatagatgttcatgaaagagaaaatccaaatgccaatgaatctgagaanatccagagattgtctcttaaactggacatgtgttgtgacaaattgagaaaaaaggaaaaaaatatctatctctctatctatatagtccactaggatgtgtggtgggtgagttcctgtaggacctgaccccgccgacacagctggtcaccttattgctgtgatgttgtctatgatttattctactcatgggtgagaaatgggatgtgatgcctgtgggttttgaaataacgtgtatattgtggagtggctaaatcaaaccagttaacatatgcgttacttcacatatttctttgtggttagaacacttaaaatttactcctttaggccgggcacggtggctcacgcctgtaatcccagcactttgggagtccgaggcgggtggatcacgaggtcaagagatcgagaccatcctggccaacatggtgaaaccctgtctctactaaaaatataaaaattagccaggtgtggtggcatgcacctgtagtcccagccactcaggaggctgaggcaggagaatcgcttgaacctgctgggaggtggaggttgcagttagccgggatcacgccactgcaccccagcctggcaacagagtgagactacgtctc

SEQ ID NO: 2367 - DNA, 197 bp, Homo sapiens
ggcaagatcttgctctgtcacccaggctggagtgcagtggcactgtcttggctcactgcagtctccacctcccgggttcaagtgattctcctgcctcagcctcccagtgctgggattacaggagtgagccactgtgcccggccaagcaacctcatttaatacatccaaatgcctccataggtgcctcttgattgtga

SEQ ID NO: 2368 - DNA, 507 bp, Homo sapiens
attgttactttttccaaatatgcctgtcagcatgcccataattttacaaaagaatcactaagcaagatatcaaaagtgactgagaggttattttagataagatcgttgaggaagacctccataaagaagtgagtttgagctgagacttgaataatgagaggaagtcctccatatgaagatctaaggtcagggcatttaagtcagaagaaatatcaaatataaatacacaatatcaaaactcagggcaggaatatatcagatatatttgaggaactgtatgaaaattgtctcaggtgaaaatcaagagattgttcaaagcttttttaataaggtgagattatagaatgtgaagaaataaaattgttacagtatatataagctggatttttcttttttctgttttgtaaagaatgtcatttttttaaaaagtgcactttttaaattcagaagttccataaatgctatctaaaatgtcacttgactaacttaattattaggtatataaag

SEQ ID NO: 2369 - DNA, 283 bp, Homo sapiens
tgtctcaaaaataaaagttacatcttgtgaaaacaacacggaagacttttaaacaataatctctaagtaggatatgcctttctaattatgactcgaaacccagagccacagaagaaatcgatccctaccaacacatatgccgaacaaagtctaccaggaaaacaccaaaaacaaagtcaaaagtcaaacaacaaatctgaaaaaacaaccgcaactgatcttaccaacaggaggcttccctaaaataaaccagttcttctgaatcaataaaaaaaaaatagtg

SEQ ID NO: 2370 - DNA, 823 bp, Homo sapiens
gtgctcttgacccactcctttgaagtgggccccttcctgaactggactgctggcctggcttactgtccccctcacttgggacaacagctgccagccaggcttgggggcttcctccaggcccagcttggcaggacatgaatcagagcctaaagtgtcaaaccctgtgcttggtccttgagaacacttcatctgtcaaccacggctgttgtagcaccactgactaaatgctcacatcttcaactgaggccaagaaccttcactgttcagatgaggaaacagaggtgttacacgggtaaactatgattcaaatgcaggctttgtgacttcagggctcacattcttaattggctctccagaatattacctgccgtctgtacaaccttgtggtctacacaatgactacagagctacattggaagatgtcattgcattctgcagaagctgaggttcagaaatgtccagtgactagctcaagatcagattgctgctaggaaacagagccagggctcatcccatctgacaccaagtccagtgttcctgtaccacatgcaccctcaagtgggcacacaagcaggaaagaacctcacgaggccatttaatctttggctgtttcaaggaaggactggcccctgaactaacacatcagaaacagatcctcaagtggggagctgaatgctacctggtgttcctatgatccattcctgctctgtttactctcccactgcctgaatggctagttcacacctcctcccctaactgctggcagagggaggggccttgcttcccatttcactaagaaaatttaagcctgggcgtggtggtt

SEQ ID NO: 2371 - DNA, 249 bp, Homo sapiens
ggctttagcgtcacacatacaaacacaactgcttctagctcttcagatgttatggctcagaaaaaccgttcctttttgtcttgttatttcaagagcaactgatttctttttggtagctctgaaatatatgccagtgtgtgggcacagtcacacagctacgcacaggcccacaccctggaaagattggaaggagtggagacacatttttcagctaggaaaggaaaaagtttgggttagcatttataaaac

SEQ ID NO: 2372 - DNA, 387 bp, Homo sapiens
ttgggctctctctcgctcacacctcttcttctgcctctctctgtcacctttttcctccttcaggtctctcagcccagcatcaccttctcagagcagcctgcatccatcccctagactagaaatatccccctttcaaataacctcatggcacccacacctcaagacaggttgcaattgaatgtctgtttatccctccctgtctccattctatccccagggcctcccactctgcctggcaaagaacggatgtgctcacatcaggaatattttaatgaaggtgctgttactggaaagggatcccaatccagaccccaagagagggttcttggatctcataaaagaaagaattcagggcgagtccataaagtgaaagcaagtccataaagg

SEQ ID NO: 2373 - DNA, 1435 bp, Homo sapiens
cagctgaatgtggaggcctttaagagaacttccagctcctgtaaaaacccagaccagaggactactgaccaacatttcaggctgatcctccagacctcgaagttactctccttactctcctgactcttaattacatcacacctgtgtcgacactctctgggaaaagactgaagaaataatcttttcaagaagcagaaagctcctgcatacataggctgatacgccacctactgcaaaaccgagctgacagcgcaggcgatgctgccagcgtttccattccatcaccaggctggggctgaataaaggcgtgcttgtgtggtagtgtctctttttaaaaaatctcaaagccaagaagaacaagctgaaatagcatcttcaaaaaatggagcgtaaaataaacagaagagaaaaagaaaaggagtatgaagggaaacacaacagcctggaagatactgatcaaggaaagaactgcaaatccacactgatgaccctcaacgttggtggatatttatacattactcaaaaacaaacactgaccaagtacccagacactttccttgaaggtatagtaaatggaaaaatcctctgcccgtttgatgctgatggtcattatttcatagacagggatggtctcctcttcaggcatgtcctaaacttcctacgaaatggagaacttctattgcccgaagggtttcgagaaaatcaacttcttgcacaagaagcagaattctttcagctcaagggactggcagaggaagtgaaatccaggtgggagaaagaacagctaacacccagagagactactttcttggaaataacagataaccacgatcgttcacaaggattaagaatcttctgtaatgctcctgatttcatatcaaaaataaagtctcgcattgttctggtgtccaaaagcaggctggatggatttccagaggagttttcaatatcgtcaaatatcatccaatttaaatacttcataaagtctgaaaatggcactcgacttgtactaaaggaagacaacacctttgtctgtaccttggaaactcttaagtttgaggctatcatgatggctttaaagtgtggctttagactgctgaccagcctggattgttccaaagggtcaattgttcacagcgatgcacttcattttatcaagtaattacctgtgtcacgaacaaaggcaacaagcatgcagccagcaagcttcggaaaaccacagcatcaaagacatcccaaataacatgcccagctagctctgtactacagagccctgctactaatcaattactgtgagctaacggtatgtaaattctatcgctaaagatgtccttcctctggggtgttcctactgatcagactcttccacctaaaatgaaaacagtaaccttctatatactgtaaataaagactgaaagcttttgctatttatttg

SEQ ID NO: 2374 - DNA, 322 bp, Homo sapiens
tgtttaattccataagtttcctatttgtgtcctgcccctgatttaactgctagaaatattactcatctctttgtgattttaaaggaagcattgaccacctcccctgccttggtttctctgtgagtcactgctagatacggctgtgggagcaggctgatgataggtaagaatcatgtatctagaatctctctccccacaaatatatgactttctagtaaaatcatgctttcaaaatagttgccattttaaatatgaatgtaagttttgatatgattaatattggaaagagccttaaattccaatgcataaatttaaaagaaaa

SEQ ID NO: 2375 - DNA, 449 bp, Homo sapiens
tccctaacggttctccaaacttaggtcagaaaggtggggaactttatttttctgggcagagagtgcatgaataatacacttgcaacctgctcagcttccctaagttctctttagctagcttctccactcgaactacacatcaatctgtcaccagtggtcagcagctcagcagagagccagtgttattgtgaacctacggtggaatgacttgcttcccagctggtgatcaatctgtgttagacggcaacatgtttgcttctacaaatgagctggacccctctgtaacatatctctgccaacttttgaaagaaagagtctgtttcaattcttttccggggtaaagacaaaaagcctgtctccctttgcacaaccagctattgaacaatccgtgcaaatatttacagccagtatcctaaagaaattgttttcagaggtcaggaagttgcact

SEQ ID NO: 2376 - DNA, 787 bp, Homo sapiens
gtcattactcccaaatatttttggagtatctgttcactcttgatttacctagagattttaagaaaaacaaacaaacaaaaaaaacaaaaacgctctggagaagctgaaaacctaatttgggtgtgggggaaggctgtcctcagacacatggacagagattaacagatataactagtaggtctaggaagccaaagctgagggctaggtactaatgggaataggacatcaagtgtgtccctctccccttcctgcccgcccccacccccacttcaatgagcaggtgtggtcagatgtttgaaacatcaccatttcagtttatgcatgatgcttgattaccgtagggaatgcagttcagacaaagttcctagctctgattggtatcatttaatcctttgttatatcactgaatctggcttttccagagctcctgaaggttttaagccttatttgttggactttgacttagaacatcgatttaaacaacttttgtgaactcccatgacatactttggttactttaaacatatttatgggacagagcatttaaaatgcctgcctgatatttacagggcctgtgaacagtcctccaaagcttgcattctgtggtgtatcaggtcagtcattaatgaggataaagctcatgtgatagccttcttacttaattcaaggcacacttctgtagggctgcactgagtcagtgtctgaggcaacagtataggccagcgttggcactctgaaaacacacccccactggctctcactgttatccgtgaaagcatccttaact

SEQ ID NO: 2377 - DNA, 455 bp, Homo sapiens
agaagttttgggctctttgataaccacattagctgctgttgaaatcccaagaaataaagaaagtcactactcatttttagccttgcaagtagtgctttgtgtgctttgaaatataacaagttttacctactaaggcacaagttcacaaaacatgaaatcattaaatcagaagtgagatagggaccatgtcacatgctgttaacttgttctgtagacagttcctctcttgacttaaatgaggtagggtccagtcatctctagtaaatgatgaacttaagtttataggacaccagtccaaagcacctaggcttcaggggttgaaggccagtattgctttcaccttctggtttaattctttaaagattctgctcgcagatttgaagatcggctttggcaaagctgccagtcctgtattacttgactttttgctgttgtctatttggatcatttctttc

SEQ ID NO: 2378 - DNA, 365 bp, Homo sapiens
gtttacattctagtgaaacatagcttctcacttttatcttttgcttgttcattccagagatatttatttgatatctactatgtgctggttgttttgctagagactagttttctctgtatacactatgttttctcagctgtccatttttgcacatattgttcatttggtcagaatacctttctcagactctcacagaagtctctggaaggacttcacctcccttccagaacgagttccaatgccagcgttactgtgaagactttctttactacactggtagttgctatatctttctcatattcagaacactatacatatctctgttataggtcttacaaagaattgtaattctcaattttagccta

SEQ ID NO: 2379 - DNA, 356 bp, Homo sapiens
cagcagatgagtgggtgaagcaaatgtgttatagccatatggtggaatattattcactcataaaaaatgaaattttcgactgggcgtggaggttcatgcctgtaatcccagcactttgggaggccaagcagggcagaacacttgaagtcaggagtttgagaccagcctggccaacatggaaaaaccccatctctactgaaatacaaaaattagctgggcatggtggcacacgcctgtaatcccagctagttgggaggctgaggcaggagaaccgcttgaacccaggaagcagggttcgcagtgaggtgagacgccactgcactccagcgtgggtgacagagtgagactcggtctca

SEQ ID NO: 2380 - DNA, 402 bp, Homo sapiens
gtgactgtattgtggggacaggaagcacaaattcccatgtggatcactaggagagataataagtggggtcatttcaccccttggtcccctgcttccagacccaaagaggcctacatggcattgtgcttccttcttagttgtaggaggtgtgagatacaatcatttgcctctgactttggagggttggtcctagcatgcccctgaccagtagccccttaaatacttcattgatatggaaggtctctgaatcttcgtgggcttaatctaccactctctgaagtgcttatgtctttcaaaggcctctaaaatctctgccatgtcttgctcatccagttgttagcatgatgtcattgatacagtggactttggaatctaagtggggagacactggtaagtgaccaa

SEQ ID NO: 2381 - DNA, 445 bp, Homo sapiens
cttatgagttaatgcagctaaagctctttagagccatgtctaacactgttaataaatgtaagatgtcattattgccactgccctcctcatcatccctaggaagaggggtgaggggcaggtgagggataaacctgtaatgcaggggaaatggactaagccactctgagaagctgtgtggaatctggaattcttggagagttagtagaggccagaccttcaggtggtatttaatgtagacagagtgtgcacaggtttgcatttgctacacagaaaaggtaaaacctgtgttgacttctcttttctgaataccgtgtcacggaatgaaagcttgtaattattttctgcaagcaaaatttcaaaagataataaaataaccagagagtttgtcaggagactgtgtaattagttgtgaatcgttttcctactaggacatcagtttacaagc

SEQ ID NO: 2382 - DNA, 346 bp, Homo sapiens
gtacttgaatgatgctttacgttattagctcccacctacccaccccaaactagactacaagctcctggaggtcagaccacatgtttgtgcctaagtgcagacttcactgtaataggaactcaaaaaactgtttgccaggtgactgataggtcctgtagtaatcccaattacttttccactagacactaaaattcagctaacataaaaaacagtcactctccccaacttcatcttcattttttaacatttaaattatagggaaatgcattgtgggagaatatttgacaattcctttagggaaagggcaataatgagaccaacccaaggcaaattaatcacagtgagg

SEQ ID NO: 2383 - DNA, 301 bp, Homo sapiens
gtatgtcaggttcatgcgagtgcagctcagagtggagcctaggagtttataaacaactttgttatgtagatttcgtgcattccttcctctccacattcatgccattactttatcattttctcgagatcctctttttagtcttctgaacagaaagatggaagttttgtttcctcactctgctgctcactttctgcagctgtgctcaagtccagcaccagccagcaagaggacagagtttaatggatgattacccctacctgttggtgccattgctctctgatcagagagaaaagctcttggg

SEQ ID NO: 2384 - DNA, 514 bp, Homo sapiens
tcgactacagctttgagttttatagcttgattaatggggaaactcaggcagggcacggaacttctctgctttgtcaaaggagttgtggctcttgctcagatcctcgtctgtaggttcaatacttaggtgccctctgccttgggttagtgataagtcacgtatgtccactgatgctcagagaggatgccgttgcattcattggatgctaagaatgcaagtttggacttaggtactgggtacagagaaaaaggtttaaacagccaagatccattagtcgactaccatgcctatgactgtgtgtaataccataaggagaaacggcacattagacagggtcccttactcatggagttctaagcctgctggggaggtggctgtgtccagtgataaccatgatacaaggcagagattgaaaagtgtcatgagcaaggactaagggtcacagcagaagttgtcatcttatttatgatgtgcctgagatactgtctgaagagcaaacttttgaccaaaaaaa

SEQ ID NO: 2385 - DNA, 443 bp, Homo sapiens
gctagttacataagtgtttgcttcatcatgattcaccaagctctgcattttgtattataaacattttcgtgtataatgcttatacattatacacgaaaatgtatataattttgtgggttatattttgtaaggtttaaaaaatggaagtcaggatgggcggttacaagtggtgactcacgcttgtaatcccagcactttggtaggcctacgcaggcagatcacttgagaccaggagttcgagaccagcctggccaacatagcaaaaccccttctctactaaaagtacaaaaattagccaggtgtggtggcaggcacctctaatcccagctacttgggaggctgaggcaggagaatcacttgaacccaggaggcagaggttgcagtgagctgagatcccgccattgcactccagtctgggcaacaagagcgaaactctgtctcca

SEQ ID NO: 2386 - DNA, 673 bp, Homo sapiens
ggcaatgatgcttagaaaggaactgctgaccgagtattaaagggtctagtttacagcataaagttattacagtgccacagaagtgctaccatgctacaaacaaatttaataactgaatcgtgtttgactaagaatatatttacacggtaaatctttagacaaagaatagtgtgtcagctaataatgaaagaatggttatactttgaatgtatatctccttcatgaagctaggtaagtttttttaggtgtttttcagctgtaaggcaaacaatgataggaagtatatgtattttacttggcacaatgtcttatcagttacctctaatcctgctatatattctaacagggttgaaagaatttcatttctttccattaagaaaacctaactagctgggcgtggtggctcatgcctgtaatctcagcactttgggaggccgcggccgggcagttcacctgaggtcaggagttcgagaccagcctaggcaacattgtgaaaccccatctctactaaaaacacaaaaaattagccaggcaaggtgacagccacctgtaatctcagctacttaggagactgagacaggagaatcgcttgaacccgggaggtggaggttgcagtgagtcgagattatgccattgtactccagcctgtgtgacagagtgagactctatctaa

SEQ ID NO: 2387 - DNA, 131 bp, Homo sapiens
tggaaaatttaatgactcaaacttataaaacacggtacctgcttgatctgttattccgatttacaacttaggtaccagttttcttaagtaaatatgccttccccgcttgcgtggtgttttaaagctcttca

SEQ ID NO: 2388 - DNA, 312 bp, Homo sapiens
actgaaaacacatttactcatttcaaaagaataagaaataaacatttgttattttcttattagaagcttccttgaatttaaataagcacttagttttcctttgtcttaattttttgtcatgataaaatcatatagtattagtacttcattgtacttaaagttactgtttttgtctgaaataatttccaaggaaaatgtgatgaaaatataaaacatgtatattatgcctaagatgagacattttggcaaaaatatacaacattaattcttaggcttttttaatcacataatttaaagtttcaatgaactatt

SEQ ID NO: 2389 - DNA, 2627 bp, Homo sapiens
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattcta

SEQ ID NO: 2390 - DNA, 2772 bp, Homo sapiens
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattctacccctgacttttggccaaaagcttacttaaaattaaggatttactaagtcatcatcagctgtttttcttaatttcagccagactattaattttgagccattatgtaatatatgccataggcaattaaaacataattttatcagaa

SEQ ID NO: 2391 - DNA, 2475 bp, Homo sapiens
aaaaaaaaaaaaaaaaaaaaatttacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattcta

SEQ ID NO: 2392 - DNA, 2546 bp, Homo sapiens
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcaggtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattcta

SEQ ID NO: 2393 - DNA, 627 bp, Homo sapiens
tcccggtagattagattctaaatcttctgtgttcgtttttctgcctgaggaatactgctgtgccaagtggctcctcaaggcgatagattgggttgcttccttgctgttggcacggcctcttcaccagtgtctacactctttttccccagctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattcta

SEQ ID NO: 2394 - DNA, 696 bp, Homo sapiens
aatactgaagtgttacttaggaaaacaaatgggcatgcagattttgatgtaattgcaactgtatgtgtctgttgtgaaagccaccagcagaattggatggttgactgtagtatcggggtgtccagtcacccatctcaaaacccagagtattacatgtctagcttaattgttaggttttaagacaaaaggaactgaggctcatcagagcagaacaacaggtagtccctaggaagtcacgtgggaatgagcttgaataagtttgttaccttgttggttggcagatgtacttggagtgtgtatcttaagcttttgttttttcacgggcatctttctgttttgagcaaaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattcta

SEQ ID NO: 2395 - DNA, 510 bp, Homo sapiens
aatactgaagtgttacttaggaaaacaaatgggcatgcagattttgatgtaattgcaactgtatgtgtctgttgtgaaagccaccagcagaattggatggttgactgtagtatcggggtgtccagtcacccatctcaaaacccagagtattacatgtctagcttaattgttaggttttaagacaaaaggaactgaggctcatcagagcagaacaacaggtagtccctaggaagtcacgtgggaatgagcttgaataagtttgttaccttgttggttggcagatgtacttggagtgtgtatcttaagcttttgttttttcacgggcatctttctgttttgagcaaaggcggcttcaatgatccatcctaaagaggtgccccctgaggccatcttgctggcagtctaccttgaactgcagaatggtgagtaattctctctgtttaggactttatcccttgaaagagcctgagattttttggttgggcaacagagcgaggctccatctcaaaa

SEQ ID NO: 2396 - DNA, 2509 bp, Homo sapiens
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaatgtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattcta

SEQ ID NO: 2397 - DNA, 2480 bp, Homo sapiens
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcaggtgctccatacttgcttgcagtgcctacgtggctctggctttgggtgataacctcatggctttgaatcatgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattcta

SEQ ID NO: 2398 - DNA, 3128 bp, Homo sapiens
  misc_feature (3041)..(3041): n is a, c, g, or t
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattctacccctgacttttggccaaaagcttacttaaaattaaggatttactaagtcatcatcagctgtttttcttaatttcagccagactattaattttgagccattatgtaatatatgccataggcaattaaaacataattttatcagaaacaccaagcacaagcaaaatcaaaacagaaatgtgtccgcggccgcagcggcgccacaaagaaaagaggcatatgaaaccactccgtgcgggcgcccgcgccccaattgggatgagacacaggggccaaacctgcgcctcgagaacacgccgcgccagtacaccgggcggactccacccaacaaaaagctcccgggcaaccggcgtcgtcaacgcacccaaggatcctgaggaacacagggtctcaacaggacacgagacgaataatgncccgccggtgaaacggagccaaacacaaggcacagcgaccagacgagccaccaacaacgagcagccacgcgaacaacaacgccgcca

SEQ ID NO: 2399 - DNA, 841 bp, Homo sapiens
aatactgaagtgttacttaggaaaacaaatgggcatgcagattttgatgtaattgcaactgtatgtgtctgttgtgaaagccaccagcagaattggatggttgactgtagtatcggggtgtccagtcacccatctcaaaacccagagtattacatgtctagcttaattgttaggttttaagacaaaaggaactgaggctcatcagagcagaacaacaggtagtccctaggaagtcacgtgggaatgagcttgaataagtttgttaccttgttggttggcagatgtacttggagtgtgtatcttaagcttttgttttttcacgggcatctttctgttttgagcaaaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattctacccctgacttttggccaaaagcttacttaaaattaaggatttactaagtcatcatcagctgtttttcttaatttcagccagactattaattttgagccattatgtaatatatgccataggcaattaaaacataattttatcagaa

SEQ ID NO: 2400 - DNA, 2822 bp, Homo sapiens
agtgggtaccgggacgccgtgaggcggaagctgtgtatggcgggaggctgtggcggtcccttggtggggaagctgttgctgttgctagacgacgggaactagctctcgtcacttcctcagcccgccgtctgcccactcctctagccggaacctgggggcccggagccggggtaggcacagagttgtcctcggaggtccaggacagcggccagcccggcggcgggagtcagggccacgccacctgcagggaagaacccgagtcgaagcgggaagatggctgcagacaagcctgcagatcagggagcagagaaacatgaaggcacaggtcagtcctctgggatcactgatcaagagaaggagttatccaccaatgctttccaagctttcacatctggaaattatgatgcctgtctacaacaccttgcctgtctacaagatataaacaaagatgattataaaataattttgaatacagcagtagctgagttttttaaaagtaaccaaacaacaacagataatttgagacaaacacttaaccagctgaagaatcaggtccactcagctgttgaagaaatggatggattagatgatgttgaaaacagcatgttgtactataatcaagcagtcattctttatcatctgcggcagtatacagaagccatatcagttggtgaaaaactttatcagttcatagagccttttgaagaaaaatttgcccaagcagtgtgttttttgcttgtagacctgtatatattaacctaccaagctgagaaagctttgcatcttcttgctgtcctagaaaaaatgatttcacagggtaacaataacaaaaatggaaagaatgagactggtaataacaacaacaaagatggatctaatcataaagctgaaagtggagctctaatagaagctgcaaaatcaaagatacatcagtacaaagtacgagcttatatccaaatgaagtctctgaaagcatgtaaaagggaaatcaagtcagtcatgaatacagctggaaattccgcaccctctctctttcttaaaagcaattttgagtacttaagaggtaattatcgaaaagccgtgaagctattaaatagttcaaacattgctgagcatccaggattcatgaaaacaggtgaatgcttgagatgcatgttctggaataaccttggttgcatccattttgccatgagcaagcacaatttgggaatattctactttaaaaaggctctgcaagagaatgacaatgtctgtgcacagctcagtgcaggtagcactgatccaggtaaaaaattttcaggaagacccatgtgtacgttactaaccaataagagatatgagttgctgtataactgtggaattcagcttcttcacattggaaggcctcttgctgccttcgaatgtctgattgaagctgttcaggtttatcatgcaaatcctcgcctctggctacggctggctgaatgctgcattgctgccaataaggggacttctgaacaagaaactaaaggccttcccagcaaaaaaggaattgtacagtctattgttggtcaaggctatcatcgtaaaatagttttggcatcacagtctatacagaatactgtttataatgatgggcagtcttcggccattcctgtagccagtatggagtttgcagccatatgtctcagaaatgccttgttgctgctacctgaagaacagcaagatccaaagcaggaaaatggggctaaaaatagtaatcaattaggtgggaacacagagagcagcgaaagcagtgaaacttgcagcagtaaaagccatgatggagataaattcattccagctccaccttcttctccattgagaaaacaggaattagaaaacttaaagtgctccatacttgcttgcagtgcctacgtggctctggctttgggtgataacctcatggctttgaatcatgcagataaacttcttcagcagcccaagctgtcaggatctcttaagtttttgggacatttatatgctgcagaagccctcatctctctcgacagaatatctgatgccattactcacttgaacccggagaatgtcactgatgtctccttagggatctcttcaaatgagcaggaccaaggatcagacaaaggtgaaaatgaagcaatggaatcctctggtaagcgggcccctcagtgctaccccagttccgtcaactctgccaggactgtgatgctgttcaaccttggcagcgcttactgcctgaggagcgaatatgacaaagcccgaaagtgtctccaccaggcggcttcaatgatccatcctaaagaggtgccccctgaggccatcttgctggcagtctaccttgaactgcagaatggtaatactcagctggccttacagatcatcaaaaggaatcagctgctccctgcagtgaaaacacactctgaagtgagaaagaagccagtgtttcagcctgtccacccgatccagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattctaaaaaaaaaaaaaaaaaaaaaaaaaaaacaaaaccacacacaccaatccttcccggaaaaattagattgggcaggttatgcatgcgcccgaatttagactcactggccaattcccctatagggagcgtttacattaactgcccgcgttttaaccggcggactggaaacccggggtacccaatatcgcttgagaaat

SEQ ID NO: 2401 - DNA, 787 bp, Homo sapiens
aatactgaagtgttacttaggaaaacaaatgggcatgcagattttgatgtaattgcaactgtatgtgtctgttgtgaaagccaccagcagaattggatggttgactgtagtatcggggtgtccagtcacccatctcaaaacccagagtattacatgtctagcttaattgttaggttttaagacaaaaggaactgaggctcatcagagcagaacaacaggtagtccctaggaagtcacgtgggaatgagcttgaataagtttgttaccttgttggttggcagatgtacttggagtgtgtatcttaagcttttgttttttcacgggcatctttctgttttgagcaaaggcggcttcaatgatccatcctaaagaggtgccccctgaggccatcttgctggcagtctaccttgaactgcagaatggtaatactcagctggccttacagatcatcaaaaggaatcagctgctccctgcagtgcagcccatccaaatgccggctttcaccactgtgcagagaaagtgatacttcacttttggaaaactgttacctgagacccaggggagaatttactggccattttagttgtatcacagcagaatgaataaaagatggtgaaggctgttaattttgagtcaattctacccctgacttttggccaaaagcttacttaaaattaaggatttactaagtcatcatcagctgtttttcttaatttcagccagactattaattttgagccattatgtaatatatgccataggcaattaaaacataattttatcagaa

SEQ ID NO: 2402 - DNA, 408 bp, Homo sapiens
caacttgttacccaataacaatttaatgttaaatttggctttcttctgtgtcccagcctcttaaattaatagatgggcctttccattatcattatgaccggacattgtaaagtacttaaggtaacacccagttttctattacttgccctcagttccttaaatcacttgccttattccttaaatagctggaagacatgtatgtgttttcaaaatcaaaagaaaggaattcagacaaattatatctgataattcaaggagtacttttagaaaagagttataaaagtgatcttttaacatatgcattttgtagttgtagcaaaagttaacacacagaggtgtttattatccttaataactattcttgctttttgaatgttctatacttttaaaatacagaatatttttact

SEQ ID NO: 2403 - DNA, 408 bp, Homo sapiens
gcactttagagtggactcagcatctctctgcttaaagatatgtccagcctactagcacagacaataggtttgttaaaattaaggaactggattgaccttaggattgactcagttagcatgtactataaaggttgactaaattgtaggtagaaaaggagggtaaagatgttcctaggaaagaggtagcataatatacagatcaaatcctgttaatgagaatgtcagtaaactatctataatcttgttgaattgaaatcctttgatgtaaacttattttggataattgggctgtttttcaggtttgaattgcttcgtgtaccaaaatattttgttgtttttgaattttgtttatcttttctttgaatcatattgaaagagatggaacttttacacaagtacacttgttgt

SEQ ID NO: 2404 - DNA, 454 bp, Homo sapiens
gtaggttgttagagggacagggtaggttggccataggctacccccaacccccgatgtgccttctgcctcctgtggtgtcatcggccagtccttgggtccttcccacttcctataaatggaggtgagctcttgcagcgctgttaatgttgggcccagccacacgcaggtgctgtgagcttcacaccccatctccccaggaggcagaaactgtgctcgccaccgctgtgacaaaagctgcacacaggatccaggtggtgatggtgaatccttcctcttgaagctcctcaccggctggtcacccaggggcctctctctggggtgggccctgcagacattgaggagtacactgaggcttgcaggcttgcatctgatgacttcctaatcctggcatgccttcgcagtgatgagctgagattcttccatctcgaagaactttcacatatcaaataagatg

SEQ ID NO: 2405 - DNA, 238 bp, Homo sapiens
taatgataccatttttaaattcttttgatagcctgctgtgacttaaagggcaaagccacaccatttaaagtgttcttctaaagctttggcagtaattctgaaacttaagctatgtgctagattatctgaaaaactttttcaaatatcgattgcaaaatgcagaactgttaaagttatttggcggtgggtttccaacatctgcaggttttttggatggtgtttgataatcattggccta

SEQ ID NO: 2406 - DNA, 418 bp, Homo sapiens
ttgagacagagtctcactctgtcgcccaggttggagtgtagtggcatgatctcagctcaccacaagctctgcctcctgggttcaggccattctcctgcctcagcctcccaaggagctgggaccacaggtgcccaccaccatgcccagataatcccttgcacccctactaaagacgggatttcaccgtgttagtcaggatggtctcgatcttgtgaccttgtgatccacccgcctcggcctcccaaaatgctgggattacaggcgtgagccactgcgcccagcggaaaagactacctttttcctagtatatcaccatggcattttgtccaaaatcaattaccatttgtttgttggcctttttcctgaactttattctatttcattgatgtgtacgtctatctttacacaaaaatcatgc

SEQ ID NO: 2407 - DNA, 786 bp, Homo sapiens
cagaaccaagaaagaacacaataagaaaacacaaagaagtcacatccccactcaagtgcgctgttccgctcagccttagaacctctgaaggaaagagttaatgatgctctgaaaatcagatgctggggaaaaccagctccccccacagacctcatccatcccacagacaggcatctgtctcccccaaactcctagcctcttcctgtctgtccctctcatttggcttggcctcatctgccttgccctacctgtgtgtaagtgtgcacgtgcgtgtacaaacctggtctcccagctagactgtgagccctgagaagtgagctactttgatgatgtttcatcacaatcccaacattacttggcatgatgctttgtccctggtggatactcaacaaacatatacagatcgctatgcacccctcccatagccacatcattaggagaggtccagggatgacgtttacgaagttacagattgcctgaagcatcgtcaggcattgcctgaaatgaaacagcagtttctgcccagctgatccagctgctgacccagcagcttctcatgatgccgattcatcccaggaacttttctccccgaaacgctgagtcagggcttggtagagaaggtgcagtgggagagaggactgcagaggccagctagaccacctggctcctccctgagcagtcggactgcactctcctgcgtgctgtactcgttcacacgctcccttgtgctctctcattctcaaaccaacctgttctctgtcccgaacccagcaagggaaacggatg

SEQ ID NO: 2408 - DNA, 561 bp, Homo sapiens
tgattctagccctgggccattgagttgcctgcagtcttcccagtgtaagattcagacatcaggaagcagagacaagcatttcagctgtgctttgtacaaattcctgactcacagaaattgtgaaagataataaaatgattgttgttagtttaagccgttatattttgggatgatttattacgcagcagtagataattgtaataaagaaatcatgaattcaaatagtagttcttcttctaattttgcatactgtctttaccacttagtaactgtgtaacctggggcaaaatttgtaatttctttgtgtctgttttcttaattgtaaatgggactcgcgtaattccctctggacttctgatgagaattagtgatttaatacttgatacgctcaataaatgttgcttgtcattattttctattaaactatattgttggatttttgagaatgcatgaagaaacttaacgttaattgtgttttgatttttaaaggcgttatgtaaattttgttttgtgcttttctccaggcaagaaaccggtttgaatgtaattttcatgaaatga

SEQ ID NO: 2409 - DNA, 666 bp, Homo sapiens
aatctatttggagagagaagacttaaacagggctataagacagtggatcactgactaaacaggctagaaaggaaggaagaaagatgatctattgggtatctactgtgagtgggatactaggctggatactttcatgtttgtcatcttttacttgtattaatatttgaacgtgtgctaagtaaatgtttcttaccttcatgcacagttgaagttgtgcttacgtagtggtggagcaatattatttcccattttttgtctttagtaaaatagtatgatttttatgagtttggtctttagctgtatcagtgacttctgaagttagccacaactagatagacttattttagttacggcaacaggatttacctaacacggtcatcgtggcttatttttacactggcaaaataccttttatttgataggctattaacaaaacatctttgctgctactttttaatcttaacgattctctttgttgcaaacagagtaccccaaatgggttggaaaggccctcatattattatagtcattgttttcttgaaacttagaatcctgaaattagccgggcatggtggcgggtgcctgtaatcccagctactcaggaggctgaggcaggagaatcgcttgaaccaggaggcggaggttgcagtgagtggagatcgcacc

SEQ ID NO: 2410 - DNA, 373 bp, Homo sapiens
ctgacaataagcccttactagaggttaggcatggttctaaatctttacatgtcacattttaccgcatttaatattagggacaatacttggttgtctgcagtggctgacacctgtaataccaatactttgggaggtcgaggtgggcagatcacttgatgtgaaaagttcaaaaccagcctggccaacaaggtaaaacccagtctctactaaaaatacaataaattagccaggcatggtggtgcacgcctgtaatccccactaatagggaggctgaagcacaaaaatcacttgaacccgggaggcggaggctgcagtaagccgggacaagcgaatgcactccagcctgggcgacagaggagactccatctcacac

SEQ ID NO: 2411 - DNA, 395 bp, Homo sapiens
cactaacactaaatttccttttcttctattattttccacatttaaaaaaataagaatgcatacttttcataattacaaaatacataaaaagcagaaaaaatacctgcaaattaaggaaataccgaccaatttaaaagcctaaaccattagctggcctgtctgccactcagctgtgaatgccagaagaggaaggacttaacctgttttattcacagctgttttcccaggccctcgcacaatagctggcgtgtagtagaaataaagttcagtaaatgcaccttcattcaaatccttgttaattttcagtcttatgtaccagcttcaatggactctaagctgcctgaatacgtgcaccctgacctcatatttgcattcctcacagcaacttggtttaa

SEQ ID NO: 2412 - DNA, 225 bp, Homo sapiens
tgtatgtattatgatgtatctgaatctatttgactatttcccattgaacgatatttgggttctttctacaattttgctatcacatgcacaaaaaaatgctaaactaagtatccgtatgcatgatgtgatttctctaagatagttagacatgtaaatatgagttcaaggggatgaatgttctgccccttttctacacagtttcattgtaactacatggagttgggg

SEQ ID NO: 2413 - DNA, 581 bp, Homo sapiens
tcttgagaagagcagtgacctctcaggtgactcaggagtgactcaggacaaagtctgaagcagccgctccaggagtgaccctgaggagaaggagtctaccctcactccatttccttccctcattggccacacccaaccagagaccagaggggaagggagtccctgatgtggtccagacagaggagtttgaaattcttgcttcaggccatatggagtggatattccttccagaaggaaattacagaccactctctgtttctactcaactgcttttcactccaggatgcttcacctcttggggccttccccagcagaggcccaggatcacctgcaaaaggcttccccaagggtggggccagaagcagggctgcagatatgtgtcctgaacctcccatggaccctgctggctcccttcaaaggcttcgggcatagcgacttgcctttccgtcttgttcagtcgtcaccagtcagccgtctgcagacttctctccctcacgttgtggcagaggagttgtacattctctagattttaaaaatatataagttactttttctttaaaataaaaattgtctctgaaata

SEQ ID NO: 2414 - DNA, 552 bp, Homo sapiens
tcttgagaagagcagtgacctctcaggtgactcaggagtgactcaggacaaagtctgaagcagccgctccaggagtgaccctgaggagaaggagtctaccctcactccatttccttccctcattggccacacccaaccagagaccagaggggaagggagtccctgatgtggtccagacagaggagtttgaaattcttgcttcaggccatatggagtggatattccttccagaaggaaattacagaccactctctgtttctactcaactgcttttcactccaggatgcttcacctcttggggccttccccagcagaggcccaggatcacctgcaaaaggcttccccaagggtggggccagaagcagggctgcagatatgtgtcctgaacctcccatggaccctgctggctcccttcaaaggcttcgggcatagcgacttgcctttccgtcttgttcagtcgtcaccagtcagccgtctgcagacttctctccctcacgttgtggcagaggagttgtacattctcaccatgttatggtcgacgcggccgcgaat

SEQ ID NO: 2415 - DNA, 290 bp, Homo sapiens
gactaaatactgtttaggccgcaggagagtttggaatccagaataaatactacctggaggtttgtcctctccatttttctctttctcctcctggcctggcctgaatattatgctactctaaatagcatatttcatccaagtgcaataatgtaagctgaatcttttttggacttctgctggcctgttttatttcttttatataaatgtgatttctcagaaattgatattaaacactatcttatcttctcctgaactgttgattttaattaaaattaagtgctaattacaaa

SEQ ID NO: 2416 - DNA, 463 bp, Homo sapiens
cagatgagaaaactatgatgcacatactttttatctgtatccaggacatgaattccaggagattaagtaaagatcctttgtgcctctctcagcatctgtcacggggcctggcacagacgtttaatatgtaatttctgattgattgattagttgataagcagaatgaaactctcacccccccaccccctccccgcccaacaaagaaaatcaaaacccctctccagtggagcgaaaccctggcagagtttgattcagcctaaggccaccccagcctgcaggacttgtgttcttatgtgacactggtcggagacatccttagactgaggtcagccaacgtatagctatgtctctgagctggtctgcacagctctgtgggcccaggggccagagtcatgctgggacccagcctccctctagcataggtcttatcatactctcgtggtcttcttttcctctacctgtt

SEQ ID NO: 2417 - DNA, 3307 bp, Homo sapiens
cccgcctcccaccctagtacccacgttttgctccacactccttgaccgcaggggctcggacacaaacccctgtcaccaggagagtcagtcagcactacttgggagggctaaagggaaatttggaaataaaattccaaagtttggagtaaaaaaattcaagtgttgattttatattctttccctttctgacacagcctaaagcgtagggggaacatgtgtttatctgtgggagataaacaagatggagtcccaaagactttaacaaaatatttttttaaaaatccactagaatagaaaatacattatttagatatactttatgctgagagtgagtatatatgcttgtcctatttaaacttgtgagaaaaagtggtatcccttgatacatttagaaatatgggggctatcttgtttcattgtgggggtggggcagaaggagaataaatgcaggatgaccctgttgaaggaatcttagcatggccaacaggggacgtttccagtcgattaccaggaaatgcaagccttggggtttctactggtggtggggctgtcatgaactttaaaatccaaagcctagacaaggaaaagtgttagaccaattgaaaagcaatccagccctttttttttttttttttttggctttgcacgacatgtcaacagaaaccatgcctttcaatataagaaataaatgtgatgatcatgtaaaatgtgaaaaattgaaagcattccagcaaaataagaattttttatatatttgttttttaagatgtatatgttaaaaaaagagaaggtcgcattatggacagacttcgtgaatgggaatttgcttagaattgtgagtagttctgaattagaaaagtatgtgaaggaaaggcagctgtaaacgtattgtgccctggagagttgtacacatgttgaaatgtaatctgggcttacctgatccatttggagtggatgtcactgccgagtctgttctcacatggaaccatgtgtgtggggttgccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatacttttttttttttaattaatagttacaggcttgttggtccagtgggatttgggtagggggagaaagataccttctaaaatggatcaatagaaccaaaataatacagcatgttctataaccacaaggaaatcaaatgatcctgtcatgattccagttagtcataactatgttagcagtgctaaatgcattttagaaatggtgacttctgtggttttcctagcatttgtctctaacaaatggtgaaataattactcatggccctctctgccattgtctttcattttttcacagtgaaattagacccctttacttcaccattctgccactgcaaattaagtataaagaaaatagcaagagtgtccacaccagtagacagtaagcttctctacctgtaagtgatgaaatcatagctaatgcacttgccatggagttttcaagatgattggtgtcagacagttttcactttgtttaaaaagtgttggtggccttttgtggtggtgttacaatcctctgggggcttaggaggatgttgatgcaacttttagaagcttttaatttcaaaaacaactcaaaaatctgaaggacagtcatagctgccactcagccccagttagtcaaaccccagtgacctttgcccctggttgccaagggctttgcaacatcaagcagggaaataaggatctgtctgtttagtggataccgtgtatcctttaatagaccaggtaacagttcgtgttagtttagactattgttttgtactgtactttcttgggtggcagaggaaagaaaagtaaaacattaaaaaaaaaaaaaaaactgcgttctttaaattctgtattattagcaacctctgtgtgtacatagtgtttgataataaagtattaatttgattcttatgtcttttgtaagtgagaacaatagactttcaggatacaaaacatgcattgaggctttgaaacatccaatgtgtaccatggctgaaaaaaagagtcacaagtggctgagacactgctccatacaggactcatgtgtggtcattgcccacccaatcttatgactccatcatcttgggacctggaacaacatgacttttttgatcgatattttgtcctcggtgttttcaaggtctgatgttggagccctgtggcccaccctcccttctccaccagcatgttggtttgaaaaggatagggaatttagaaacagttctgtactttggtttggtttggttttctgtttgtgattgttttcatggactgttttattttttcccaggaagagtctttatcaatatcatgtgcagctcactcatggaaatggttgcaaaccaatcagtgtaggaagcttaaatggggctgtttccctctctgtgtcgttgtgaaaggaagagtcacacagtacctgtggattttcagggactctgtttttctccggtgccttagcaacggcagcagccatttgtattattttcaaataattagaaaaacagttttcaactcctcctttccattcattgctctcagagttgtggtcactgacttttcttttgaaaaccgcctccaccaacacccccgtttgcctacaccaccccccttttacttagtatgtttattttttgtgtgtctcttgccttcctcccacgttttatttcccctcagagctgtgaatgggcaggtctgtctctggtttggcatcactgagtttttcccatgcattggccccagggctgctaggatgtgagacaaatctccctacaatgggcttgctcccattgtctgtacagtttaatagatgctggcatgtcggaggttacccatgagtcaaaatccgctctccatgcttactcttgacaccccattgaagccactcattgtgtgtgcgtctgggtgtgaagtccagctccgtgtggtcctgtgcttgtactgccctgctttgcagttcctttgcacttactcatcgagtgctgttttgaaatgctgacattatataaacgtaaaagaaaatgtaaaaaaaaaaaacccacacacaaacaaacccatacgatctgtatttgtatatacacgtgtccgtacaagtataactaaataaaaattaaagattttcatcattttaattggatccctccttc

SEQ ID NO: 2418 - DNA, 2147 bp, Homo sapiens
agtgactatacctcatataattatcatctgtttccaaaaaaaaatctttgtataaaaagaccccgtggtgccacgagtttgaatggggaaaacaccctccaatggctccattgccccattaaatccccacgttcaaacgccccgggaatcccagtgctccggtcagatcgccgttgttcataactatgttagcagtgctaaatgcattttagaaatggtgacttctgtggttttcctagcatttgtctctaacaaatggtgaaataattactcatggccctctctgccattgtctttcattttttcacagtgaaattagacccctttacttcaccattctgccactgcaaattaagtataaagaaaatagcaagagtgtccacaccagtagacagtaagcttctctacctgtaagtgatgaaatcatagctaatgcacttgccatggagttttcaagatgattggtgtcagacagttttcactttgtttaaaaagtgttggtggccttttgtggtggtgttacaatcctctgggggcttaggaggatgttgatgcaacttttagaagcttttaatttcaaaaacaactcaaaaatctgaaggacagtcatagctgccactcagccccagttagtcaaaccccagtgacctttgcccctggttgccaagggctttgcaacatcaagcagggaaataaggatctgtctgtttagtggataccgtgtatcctttaatagaccaggtaacagttcgtgttagtttagactattgttttgtactgtactttcttgggtggcagaggaaagaaaagtaaaacattaaaaaaaaaaaaaaaactgcgttctttaaattctgtattattagcaacctctgtgtgtacatagtgtttgataataaagtattaatttgattcttatgtcttttgtaagtgagaacaatagactttcaggatacaaaacatgcattgaggctttgaaacatccaatgtgtaccatggctgaaaaaaagagtcacaagtggctgagacactgctccatacaggactcatgtgtggtcattgcccacccaatcttatgactccatcatcttgggacctggaacaacatgacttttttgatcgatattttgtcctcggtgttttcaaggtctgatgttggagccctgtggcccaccctcccttctccaccagcatgttggtttgaaaaggatagggaatttagaaacagttctgtactttggtttggtttggttttctgtttgtgattgttttcatggactgttttattttttcccaggaagagtctttatcaatatcatgtgcagctcactcatggaaatggttgcaaaccaatcagtgtaggaagcttaaatggggctgtttccctctctgtgtcgttgtgaaaggaagagtcacacagtacctgtggattttcagggactctgtttttctccggtgccttagcaacggcagcagccatttgtattattttcaaataattagaaaaacagttttcaactcctcctttccattcattgctctcagagttgtggtcactgacttttcttttgaaaaccgcctccaccaacacccccgtttgcctacaccaccccccttttacttagtatgtttattttttgtgtgtctcttgccttcctcccacgttttatttcccctcagagctgtgaatgggcaggtctgtctctggtttggcatcactgagtttttcccatgcattggccccagggctgctaggatgtgagacaaatctccctacaatgggcttgctcccattgtctgtacagtttaatagatgctggcatgtcggaggttacccatgagtcaaaatccgctctccatgcttactcttgacaccccattgaagccactcattgtgtgtgcgtctgggtgtgaagtccagctccgtgtggtcctgtgcttgtactgccctgctttgcagttcctttgcacttactcatcgagtgctgttttgaaatgctgacattatataaacgtaaaagaaaatgtaaaaaaaaaaaacccacacacaaacaaacccatacgatctgtatttgtatatacacgtgtccgtacaagtataactaaataaaaattaaagattttcatcattttaattggatccctccttc

SEQ ID NO: 2419 - DNA, 2229 bp, Homo sapiens
cccgcctcccaccctagtacccacgttttgctccacactccttgaccgcaggggctcggacacaaacccctgtcaccaggagagtcagtcagcactacttgggagggctaaagggaaatttggaaataaaattccaaagtttggagtaaaaaaattcaagtgttgattttatattctttccctttctgacacagcctaaagcgtagggggaacatgtgtttatctgtgggagataaacaagatggagtcccaaagactttaacaaaatatttttttaaaaatccactagaatagaaatggtgacttctgtggttttcctagcatttgtctctaacaaatggtgaaataattactcatggccctctctgccattgtctttcattttttcacagtgaaattagacccctttacttcaccattctgccactgcaaattaagtataaagaaaatagcaagagtgtccacaccagtagacagtaagcttctctacctgtaagtgatgaaatcatagctaatgcacttgccatggagttttcaagatgattggtgtcagacagttttcactttgtttaaaaagtgttggtggccttttgtggtggtgttacaatcctctgggggcttaggaggatgttgatgcaacttttagaagcttttaatttcaaaaacaactcaaaaatctgaaggacagtcatagctgccactcagccccagttagtcaaaccccagtgacctttgcccctggttgccaagggctttgcaacatcaagcagggaaataaggatctgtctgtttagtggataccgtgtatcctttaatagaccaggtaacagttcgtgttagtttagactattgttttgtactgtactttcttgggtggcagaggaaagaaaagtaaaacattaaaaaaaaaaaaaaaactgcgttctttaaattctgtattattagcaacctctgtgtgtacatagtgtttgataataaagtattaatttgattcttatgtcttttgtaagtgagaacaatagactttcaggatacaaaacatgcattgaggctttgaaacatccaatgtgtaccatggctgaaaaaaagagtcacaagtggctgagacactgctccatacaggactcatgtgtggtcattgcccacccaatcttatgactccatcatcttgggacctggaacaacatgacttttttgatcgatattttgtcctcggtgttttcaaggtctgatgttggagccctgtggcccaccctcccttctccaccagcatgttggtttgaaaaggatagggaatttagaaacagttctgtactttggtttggtttggttttctgtttgtgattgttttcatggactgttttattttttcccaggaagagtctttatcaatatcatgtgcagctcactcatggaaatggttgcaaaccaatcagtgtaggaagcttaaatggggctgtttccctctctgtgtcgttgtgaaaggaagagtcacacagtacctgtggattttcagggactctgtttttctccggtgccttagcaacggcagcagccatttgtattattttcaaataattagaaaaacagttttcaactcctcctttccattcattgctctcagagttgtggtcactgacttttcttttgaaaaccgcctccaccaacacccccgtttgcctacaccaccccccttttacttagtatgtttattttttgtgtgtctcttgccttcctcccacgttttatttcccctcagagctgtgaatgggcaggtctgtctctggtttggcatcactgagtttttcccatgcattggccccagggctgctaggatgtgagacaaatctccctacaatgggcttgctcccattgtctgtacagtttaatagatgctggcatgtcggaggttacccatgagtcaaaatccgctctccatgcttactcttgacaccccattgaagccactcattgtgtgtgcgtctgggtgtgaagtccagctccgtgtggtcctgtgcttgtactgccctgctttgcagttcctttgcacttactcatcgagtgctgttttgaaatgctgacattatataaacgtaaaagaaaatgtaaaaaaaaaaaacccacacacaaacaaacccatacgatctgtatttgtatatacacgtgtccgtacaagtataactaaataaaaattaaagattttcatcattttaattggatccctccttc

SEQ ID NO: 2420 - DNA, 2697 bp, Homo sapiens
cccgcctcccaccctagtacccacgttttgctccacactccttgaccgcaggggctcggacacaaacccctgtcaccaggagagtcagtcagcactacttgggagggctaaagggaaatttggaaataaaattccaaagtttggagtaaaaaaattcaagtgttgattttatattctttccctttctgacacagcctaaagcgtagggggaacatgtgtttatctgtgggagataaacaagatggagtcccaaagactttaacaaaatatttttttaaaaatccactagaatagaaaatacattatttagatatactttatgctgagagtgagtatatatgcttgtcctatttaaacttgtgagaaaaagtggtatcccttgatacatttagaaatatgggggctatcttgtttcattgtgggggtggggcagaaggagaataaatgcaggatgaccctgttgaaggaatcttagcatggccaacaggggacgtttccagtcgattaccaggaaatgcaagccttggggtttctactggtggtggggctgtcatgaactttaaaatccaaagcctagacaaggaaaagtgttagaccaattgaaaagcaatccagccctttttttttttttttttttggctttgcacgacatgtcaacagaaaccatgcctttcaatataagaaataaatgtgatgatcatgtaaaatgtgaaaaattgaaagcattccagcaaaataagaattttttatatatttgttttttaagatgtatatgttaaaaaaagagaaggtcgcattatggacagacttcgtgaatgggaatttgcttagaattgtgagtagttctgaattagaaaagtatgtgaaggaaaggcagctgtaaacgtattgtgccctggagagttgtacacatgttgaaatgtaatctgggcttacctgatccatttggagtggatgtcactgccgagtctgttctcacatggaaccatgtgtgtggggttgccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatacttttttttttttaattaatagttacaggcttgttggtccagtgggatttgggtagggggagaaagataccttctaaaatggatcaatagaaccaaaataatacagcatgttctataaccacaaggaaatcaaatgatcctgtcatgattccagttagtcataactatgttagcagtgctaaatgcattttagaaatggtgacttctgtggttttcctagcatttgtctctaacaaatggtgaaataattactcatggccctctctgccattgtctttcattttttcacagtgaaattagacccctttacttcaccattctgccactgcaaattaagtataaagaaaatagcaagagtgtccacaccagtagacagtaagcttctctacctgtaagtgatgaaatcatagctaatgcacttgccatggagttttcaagatgattggtgtcagacagttttcactttgtttaaaaagtgttggtggccttttgtggtggtgttacaatcctctgggggcttaggaggatgttgatgcaacttttagaagcttttaatttcaaaaacaactcaaaaatctgaaggacagtcatagctgccactcagccccagttagtcaaaccccagtgacctttgcccctggttgccaagggctttgcaacatcaagcagggaaataaggatctgtctgtttagtggataccgtgtatcctttaatagaccaggtaacagttcgtgttagtttagactattgttttgtactgtactttcttgggtggcagaggaaagaaaagtaaaacattaaaaaaaaaaaaaaaactgcgttctttaaattctgtattattagcaacctctgtgtgtacatagtgtttgataataaagtattaattggaaaaaaaaaaaaaaaaaaaaaaaaaaaaaaaaaaaaaaaaaaaaaaaaaaaaaaaaaaaaagaggggggcccaccaaagaagcacccgcggaagggcacacagacgcccaaacaccccaccagaaggaacagaggggccccacaacacgacgcccaaaaatgagaccaacggcgacgggaggaaaaacgcaccaacaacccgcaccgggaggacaaacacggacagcaagaggcaaacagggacgaaagggaacacaagaacgcgagggggaaaacacaaaaaagaagaccaaaaccacacccagacaagcacaacaaacaccacaaccgaagatcacagaaaccacctacaaagaacacacaaccgcggaccaacaaagagcaccacacacaacgcgcagcacacacaagacacaaaaaatgcagaacaaacagagaagcacacaaacacccagaaacgcaccaacataatacaaagtagccagcgacagccggcgcacagacttcaaaaaagagcgagaaaaaacaagcaaccgaccgcggacacccgacaaagaacaagaaccagcgaacgcgcaacaccaacgagagaggacaagcgcagaggagggcgcgggggcgggcggacc

SEQ ID NO: 2421 - DNA, 1686 bp, Homo sapiens
  misc_feature (23)..(23): n is a, c, g, or t
  misc_feature (30)..(30): n is a, c, g, or t
  misc_feature (42)..(42): n is a, c, g, or t
gaagcttttaatttcaaaaagtngcatcancatcctcctaancccccagaggattgtaacacaatcctctgggggcttaggaggatgttgatgcaacttttagaagcttttaatttcaaaaacaactcaaaaatctgaaggacagtcatagctgccactcagccccagttagtcaaaccccagtgacctttgcccctggttgccaagggctttgcaacatcaagcagggaaataaggatctgtctgtttagtggataccgtgtatcctttaatagaccaggtaacagttcgtgttagtttagactattgttttgtactgtactttcttgggtggcagaggaaagaaaagtaaaacattaaaaaaaaaaaaaaaactgcgttctttaaattctgtattattagcaacctctgtgtgtacatagtgtttgataataaagtattaatttgattcttatgtcttttgtaagtgagaacaatagactttcaggatacaaaacatgcattgaggctttgaaacatccaatgtgtaccatggctgaaaaaaagagtcacaagtggctgagacactgctccatacaggactcatgtgtggtcattgcccacccaatcttatgactccatcatcttgggacctggaacaacatgacttttttgatcgatattttgtcctcggtgttttcaaggtctgatgttggagccctgtggcccaccctcccttctccaccagcatgttggtttgaaaaggatagggaatttagaaacagttctgtactttggtttggtttggttttctgtttgtgattgttttcatggactgttttattttttcccaggaagagtctttatcaatatcatgtgcagctcactcatggaaatggttgcaaaccaatcagtgtaggaagcttaaatggggctgtttccctctctgtgtcgttgtgaaaggaagagtcacacagtacctgtggattttcagggactctgtttttctccggtgccttagcaacggcagcagccatttgtattattttcaaataattagaaaaacagttttcaactcctcctttccattcattgctctcagagttgtggtcactgacttttcttttgaaaaccgcctccaccaacacccccgtttgcctacaccaccccccttttacttagtatgtttattttttgtgtgtctcttgccttcctcccacgttttatttcccctcagagctgtgaatgggcaggtctgtctctggtttggcatcactgagtttttcccatgcattggccccagggctgctaggatgtgagacaaatctccctacaatgggcttgctcccattgtctgtacagtttaatagatgctggcatgtcggaggttacccatgagtcaaaatccgctctccatgcttactcttgacaccccattgaagccactcattgtgtgtgcgtctgggtgtgaagtccagctccgtgtggtcctgtgcttgtactgccctgctttgcagttcctttgcacttactcatcgagtgctgttttgaaatgctgacattatataaacgtaaaagaaaatgtaaaaaaaaaaaacccacacacaaacaaacccatacgatctgtatttgtatatacacgtgtccgtacaagtataactaaataaaaattaaagattttcatcattttaattggatccctccttc

SEQ ID NO: 2422 - DNA, 1849 bp, Homo sapiens
  misc_feature (1849)..(1849): n is a, c, g, or t
cccgcctcccaccctagtacccacgttttgctccacactccttgaccgcaggggctcggacacaaacccctgtcaccaggagagtcagtcagcactacttgggagggctaaagggaaatttggaaataaaattccaaagtttggagtaaaaaaattcaagtgttgattttatattctttccctttctgacacagcctaaagcgtagggggaacatgtgtttatctgtgggagataaacaagatggagtcccaaagactttaacaaaatatttttttaaaaatccactagaatagaaaatacattatttagatatactttatgctgagagtgagtatatatgcttgtcctatttaaacttgtgagaaaaagtggtatcccttgatacatttagaaatatgggggctatcttgtttcattgtgggggtggggcagaaggagaataaatgcaggatgaccctgttgaaggaatcttagcatggccaacaggggacgtttccagtcgattaccaggaaatgcaagccttggggtttctactggtggtggggctgtcatgaactttaaaatccaaagcctagacaaggaaaagtgttagaccaattgaaaagcaatccagccctttttttttttttttttttggctttgcacgacatgtcaacagaaaccatgcctttcaatataagaaataaatgtgatgatcatgtaaaatgtgaaaaattgaaagcattccagcaaaataagaattttttatatatttgttttttaagatgtatatgttaaaaaaagagaaggtcgcattatggacagacttcgtgaatgggaatttgcttagaattgtgagtagttctgaattagaaaagtatgtgaaggaaaggcagctgtaaacgtattgtgccctggagagttgtacacatgttgaaatgtaatctgggcttacctgatccatttggagtggatgtcactgccgagtctgttctcacatggaaccatgtgtgtggggttgccagcctcacagatacaatcaatcctattcccctctgacataaggaactcctctggagtggcagagtcttatcacagaaggcagccaccatttcaccaaaacaaaagttcacggcattcaattcctttttcctttagctatttatatatgcagtactctcagtcatatgcagaaatacttttttttttttaattaatagttacaggcttgttggtccagtgggatttgggtagggggagaaagataccttctaaaatggatcaatagaaccaaaataatacagcatgttctataaccacaaggaaatcaaatgatcctgtcatgattccagttagtcataactatgttagcagtgctaaatgcattttagaaatggtgacttctgtggttttcctagcatttgtctctaacaaatggtgaaataattactcatggccctctctgccattgtctttcattttttcacagtgaaattagacccctttacttcaccattctgccactgcaaattaagtataaagaaaatagcaagagtgtccacaccagtagacagtaagcttctctacctgtaagtgatgaaatcatagctaatgcacttgccatggagttttcaagatgattggtgtcagacagttttcactttgtttaaaaagtgttggtggccttttgtggtggtgttacaatcctctgggggcttaggaggatgttgatgcaacttttagaagcttttaatttcaaaaacaactcaaaaatctgaaggacagtcatagctgccactcagccccagttagtcggcaggtaaatacaggtcctgtctcgctaaggggatacccgggatcctttaacn

SEQ ID NO: 2423 - DNA, 575 bp, Homo sapiens
ggattacaggtatgcacctccaccacgcccagctaattttttgtatttttagtagagatggggtttcattatgttggccaggctggtctcgaactcctagcctcacgtgttctgcctgcctctgcctccgcctcccaaagtgctgggattacagatgtgagccaccaagcccggccataaagttggttctaaactcctgctacatagaatgacataaaagactttgccagacataaagagctaaagatgccagacacacggaagacatgctgtaagatttcattcgcatgaagttcaaaaacagacacaacgaatctctgtgcctgtttttgaaaggcattagatgggtggttgcttctggagcaggggaattgacagggaaagagcacaaggaagacgtctgggtgctggaaatgttctctgattagcggttacatggatgcataaatttgtgaaaattcattacctggtacacttaagatctgtgccctttatatactttaccacacttaagttatatgtcacccaaaaagaaaataaataaaaataaagaaaaataagtacttatacatttt

SEQ ID NO: 2424 - DNA, 369 bp, Homo sapiens
catggttaggggtgaaggagggttggggagatgttggtcaaaggatacataattacagttgaataggaggaatacattcaagagatctattggacagcatggtggctatagttaatgacattgtaatcttggaaaacattgtgtttttgaaaaacacagcagatgttaagtgttctcattactaaaataactatgtgaggtaaaacattttttaattagctagagttaaccatttcacaatgtacgtatacttcaaaacattatgttgtacatgacatatacacacagttttatctgtcagttgggatcacctgaggtcaggagtttgagaccaacctggccaacattgtgaaaccccagctctactta

SEQ ID NO: 2425 - DNA, 257 bp, Homo sapiens
tgggggttccttattagctgccactggtattcaggggaggctccttggaggaacaggggaagaccgcaagaccttctccctcagggtttggagaatgaaactgactttgtaagggagggactttcttctgggcaaagatccctcttcaagaagaagaaagaagagaacaggtccctgtcacaggctgcatagggccttgtatttctttgctcctttgccacaattctgattttaaaatgaattgtgtaaaaaatttg

SEQ ID NO: 2426 - DNA, 619 bp, Homo sapiens
gacagttaccttgaaatgctacgggaaggatgagcatggagagctgcctgttattctgagccaacttctggcaagatgctgggtgaatcgactgcctagaattgaagaactggctctcaagcagttgctgctaaagaatgccagcaaacaaaccacacacaactgtggtaagccaggcggaaatccctccaccctctggcatgagatggcagtctagaaaggactctccatgagatgcctggggcctgaggaagcagaggcatggacacactgttctacgatgactcagggccacccatgagtgggacattcgtggggatgagatgggagcagggagaagcagcagttgtaatggccagccacgtggggaccagttccgtgcctggcctttctttctctggtggaagccatcttgttttgatcctaagaaaaatgggtgtcattttatccaggaatctaagaattataataataaattaataaagtgaatgtgataatcaaactgtgaggatacgaacaacataagatttaatgatcgttgtcaaaaccagtccgtagggctgtggaactttatcgtacaattcgactttgatatgtgtttaaatatattttctaagtt

SEQ ID NO: 2427 - DNA, 471 bp, Homo sapiens
ttttggccacaacaaagaaactataaatattgctctaaatgtgaaactttcagatattaaatcctaaattgaagacataccaatctgggtatgagcgatacagagttgcctagtggtacaaacacataagaggagataagagtagcatgggggagatgaccgaattgagaaagaaaagaaataggaatcaagttttattccacaaccctggaataaaacctgcaggagtagagggaggcaaacaaatgagactcttggaaaagcctgctctgttgtctgagggatgtcagattcaaagtaagttgatgctggctggtcgcggtggttcatgcctgtaatcccagcactttgggaggctgaggagggtggatcacgaggtcaggagttcgagaccagcctggccagcatagtgaaaccctgtgtccactaaaaatacaaaaactaactgggcatggtggtgcatgcctgtag

SEQ ID NO: 2428 - DNA, 211 bp, Homo sapiens
gtcacagtttatatagcattatgacagaggtttaatgcatttgatggtatctgaagataaaaaaatcctccagggtttatatttgtttaccatatgtttatcatatatattccttatttacttgtttatcatacatatttaccacagggaacttcccatactgcaggtactcaatacattgtttcagaattcagttccacagagtgatttc

SEQ ID NO: 2429 - DNA, 554 bp, Homo sapiens
ggtagagacagggtcttgttatgttgcccatgctggttccagaactcctaggctcctcaagcaatcctcccaccttagcctcccaaagtgctacaggcatgagccaccacacccagccaccaatagtgtaatcgtatcagccacatctttttcaatgaaatcagaggaattacaaagtaaatcggtggaagcagtattgtgcagtaataaacaaaacatctacaaaaacaaacatacacgtaaaaatctcagactcagaattttgtccctgccaggcatggttggtcatgcctgtaattccaatactttgggaggccaaggcaggacatgactcaaggacaggagttcaagaccagcctgggcaacatagcgaaaacccatctctacaaaaattttaaaacattatctgggagcactggcatgcacctgtggtcgtagctacttggcaggctgaggcaggaagaacccttgaacccaggagttcaaggcttcagtgagccatgatcgctccactacactccagcctgggtgacagagtaagaccctgtctctaa

SEQ ID NO: 2430 - DNA, 3180 bp, Homo sapiens
ggcagcgagcggcctggcggggcgggcggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2431 - DNA, 1855 bp, Homo sapiens
ggcagcgagcggcctggcggggcgggcggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctg

SEQ ID NO: 2432 - DNA, 785 bp, Homo sapiens
  misc_feature (782)..(782): n is a, c, g, or t
ggcagcgagcggcctggcggggcgggcggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccccacaattcgggggcaattgtnggg

SEQ ID NO: 2433 - DNA, 1580 bp, Homo sapiens
ggcagtcggccgggtgaatcggcgagggggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2434 - DNA, 981 bp, Homo sapiens
aaggctggtaccggcctcggattttttggatccggcatgggccggggctggcaggctgcggggctcgcctgccgggagggtcgggctgcagaggctccgcgccctgccgtgggcgaccccgtctacctctggcggaggccccgcccggtcacgccgacctctccggtgcagccaccgcgctgagatctggagccacggcctccctgcttctccgtaaccaccagcaaccagcttgcccggctccggtccaggggttcccctggcctccgggcgagcgtccctgtctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggtcactcccttcaagctccctgggccc

SEQ ID NO: 2435 - DNA, 3199 bp, Homo sapiens
  misc_feature (27)..(27): n is a, c, g, or t
agggcttttgggtttacccggcccccncctgatgtactgtgatatctgtcgatccagcgctcctctggatgtgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2436 - DNA, 3167 bp, Homo sapiens
aaacttcggctaggtcgaggctgggtttaaattcggccgtgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2437 - DNA, 1791 bp, Homo sapiens
ggcagcgagcggcctggcggggcgggcggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccgggttataacctttcccgccgaggctcctcctt

SEQ ID NO: 2438 - DNA, 3307 bp, Homo sapiens
agcgggttgcccggggaccgggcccgcgttctgggtggcgtcctcgtccggcatgggccggggctggcaggctgcggggctcgcctgccgggagggtcgggctgcagaggctccgcgccctgccgtgggcgaccccgtctacctctggcggaggccccgcccggtcacgccgacctctccggtgcagccaccgcgctgagatctggagccacggcctccctgcttctccgtaaccaccagcaaccagcttgcccggctccggtccaggggttcccctggcctccgggcgagcgtccctgtctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2439 - DNA, 3023 bp, Homo sapiens
tagctaggtacgagcctgtgtgttgaattggccgaggctgtgccgaatgacatgaggtgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2440 - DNA, 3253 bp, Homo sapiens
  misc_feature (27)..(27): n is a, c, g, or t
agggcttttgggtttacccggcccccncctgatgtactgtgatatctgtcgatccagcgctcctctggatgtgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagccccctcacccgatacccgccggggacatactttcctcagaaggctgctcccagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2441 - DNA, 3591 bp, Homo sapiens
agcgggttgcccggggaccgggcccgcgttctgggtggcgtcctcgtccggcatgggccggggctggcaggctgcggggctcgcctgccgggagggtcgggctgcagaggctccgcgccctgccgtgggcgaccccgtctacctctggcggaggccccgcccggtcacgccgacctctccggtgcagccaccgcgctgagatctggagccacggcctccctgcttctccgtaaccaccagcaaccagcttgcccggctccggtccaggggttcccctggcctccgggcgagcgtccctgtctatgacatggtgcattacggccactccaaccagctgcgccaggcacgggccatgggtgactacctcatcgtaggcgtgcacaccgatgctaaagagaaggggcacctgctccccaccactgccagcgaggctcccaagccttcaggggctgagcacctgctcgtcagaaggaatctctgcctttgcctgagaccctcgcagggaagagagccacccagttggccagcactagtgggctaagggccagggtagagagacagcctgcccccaccggccctcttgtgtggctacagctgggtgctgggaaggggcctcctactggaggggccgggtgggctggggtccccagtctccccgttgtccttttcctagaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2442 - DNA, 3467 bp, Homo sapiens
agcgggttgcccggggaccgggcccgcgttctgggtggcgtcctcgtccggcatgggccggggctggcaggctgcggggctcgcctgccgggagggtcgggctgcagaggctccgcgccctgccgtgggcgaccccgtctacctctggcggaggccccgcccggtcacgccgacctctccggtgcagccaccgcgctgagatctggagccacggcctccctgcttctccgtaaccaccagcaaccagcttgcccggctccggtccaggggttcccctggcctccgggcgagcgtccctgtctatgacatggtgcattacggccactccaaccagctgcgccaggcacgggccatgggtgactacctcatcgtaggcgtgcacaccgatgctaaagagaaggggcacctgctccccaccactgccagcgaggctcccaagccttcaggggctgagcacctgctcgtcagaaggaatctctgcctttgcctgagaccctcgcagggaagagagccacccagttggccagcactagtgggctaagggccaggaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2443 - DNA, 3102 bp, Homo sapiens
ggcagcgagcggcctggcggggcgggcggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccagtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2444 - DNA, 3001 bp, Homo sapiens
ttggactcggtgctctgaattttacattagtgcacggcttgtccgctgaccgtctgcatgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2445 - DNA, 3354 bp, Homo sapiens
ggcagcgagcggcctggcggggcgggcggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggtgagtcggcggcggaatccccgaggcccctgggtcgaggtctccaggggaaaggaggggcacctccctgccctctcagggtcctcctgcccactgctccccatccccagccggttctggggtggccacgccgggagggcaggcccctcagccctgctctgaccttctgtgcaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2446 - DNA, 3244 bp, Homo sapiens
agcgggttgcccggggaccgggcccgcgttctgggtggcgtcctcgtccggcatgggccggggctggcaggctgcggggctcgcctgccgggagggtcgggctgcagaggctccgcgccctgccgtgggcgaccccgtctacctctggcggaggccccgcccggtcacgccgacctctccggtgcagccaccgcgctgagatctggagccacggcctccctgcttctccgtaaccaccagcaaccagcttgcccggctccggtccaggggttcccctggcctccgggcgagcgtccctgtctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2447 - DNA, 3366 bp, Homo sapiens
  misc_feature (27)..(27): n is a, c, g, or t
agggcttttgggtttacccggcccccncctgatgtactgtgatatctgtcgatccagcgctcctctggatgtgccaggctgtccgcgccgccgctgcggggccatgatccggaacgggcgcggggctgcaggcggcgcagagcagccgggcccggggggcaggcgcgccgtgagggtgtggtgcgatggctgccaccgcgctgagatctggagccacggcctccctgcttctccgtaaccaccagcaaccagcttgcccggctccggtccaggggttcccctggcctccgggcgagcgtccctgtctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagccccctcacccgatacccgccggggacatactttcctcagaaggctgctcccagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2448 - DNA, 2408 bp, Homo sapiens
gacagccgggaggggcacaccctgtccccccaaaaagtctccgggctgagctagccgcactctggccgcaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2449 - DNA, 1146 bp, Homo sapiens
ggcagcgagcggcctggcggggcgggcggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggagcccaagagaaggggcatcttccgtcagattgacagtggcagcaacctcaccacagacctcatcgtccagcggatcatcaccaacaggttggagtatgaggcgcgaaaccagaagaaggaagccaaggaggtctttctggaggtgcaaagacagtag

SEQ ID NO: 2450 - DNA, 2957 bp, Homo sapiens
tagctaggtacgagcctgtgtgttgaattggccgaggctgtgccgaatgacatgaggtgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2451 - DNA, 2398 bp, Homo sapiens
tgattgactcatgatggatcccatggtactcctcatctgcgtgctttacactcttgactcggagtgtaatcacgacatggtgaaaatccatcccgttatgaatcagtctaaacggacgcttaccgtgctggcctgccgctacgtgtcacaacttctgactgggaacccccctgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagagggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccctgctgggaaggaccagggaaccactcagcaaggagaccctcttggccctgcccccaccatgcacccagcagccgggagtgcagcgggcagcctggcagtgagtgaaacccaggcctccagccctccaaagcctggggccaccccctgtagcaggcgatgctagaataaggaggagagccagagctgaggctccttgccccttggcccctccaggggccatgggatctctgtctcccacacccctgtcacggcccgcctggagcagcccagaggccgaagaggttcttactgcagcctccgggaggtgtctagggaggccatagattgcctggtctcgccgcattcaaaatgaggcttatgatcagtacttttttcagccccacattcctctccagaatggcctctgccctacagcacctggcccatgtggcaccccatgggcctgtcctctgctgttgtgaggtcgacctcacgacccagcacaggagctggaggcgaggtgcacgcgaggctctccacagcccaggaaggcagcctgtcaccctgctctccgagccaggggccaaggtgtggggggcacaggccatcctcatcctgccaggcccccgctttcaggagtggggtggtgccaatgctcccactcagaaccctggactgcggggtcccctgagcagagggaccagccagttccccatagacagattggtgctggacaggggctgcctgggccccaggcttggggagggtagaaaggccctgcagtgctgctgcctgggcccggaggtgggcctggccccgtagcagcattggaggccagagcccaagccagttccggagtcacacccaacggcggagggagaacctacccatctcccaccttcagctctggggaggcatgctctgggcctctggagccagggctcaggcccccaactctcctccttgcccctgcaccctcggacttggcctggccagaagggatgggggcaagaggaaggcagccaggggctccagcccatgccctcacagatttggctctcgagttggggagcgaagggctgggggaggacactgggaaccgggccagccgtggccctgcacttcccccagggagcaccaaggctaggcgcggcttcaccgcggggctgggtcgtggccagcttcgcccctgggtctgaagacctctgggcggcccaggccaaccttgccctgccgccgcacactcggctgccttctcatacccaggcttggggatttccaggtcccgttcccctcgtggcctggctgccagtcctccagcacccctca

SEQ ID NO: 2452 - DNA, 1044 bp, Homo sapiens
ggcagcgagcggcctggcggggcgggcggcggcgctcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggtgagtcggcggcggaatccccgaggcccctgggtcgaggtctccaggggaaaggaggggcacctccctgccctctcagggtcctcctgcccactgctccccatccccagccggttctggggtggccacgccgggagggcaggcccctcagccctgctctgaccttctgtgcaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggtcactcccttcaagctccctgggccc

SEQ ID NO: 2453 - DNA, 821 bp, Homo sapiens
  misc_feature (27)..(27): n is a, c, g, or t
agggcttttgggtttacccggcccccncctgatgtactgtgatatctgtcgatccagcgctcctctggatgtgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagattcgaaagttccccgaaagattatattgggcgttttcccattggcggacggcaaaaaaggccgggcaacgggacaccaacaacgaaagagccacaacacgaaagtgcggggaaggcaaaagcggaaaccgaaaaggtaatatcccgaagttttccctttac

SEQ ID NO: 2454 - DNA, 2694 bp, Homo sapiens
  misc_feature (1217)..(1217): n is a, c, g, or t
  misc_feature (1255)..(1255): n is a, c, g, or t
  misc_feature (1270)..(1270): n is a, c, g, or t
  misc_feature (1310)..(1310): n is a, c, g, or t
  misc_feature (1314)..(1314): n is a, c, g, or t
  misc_feature (1738)..(1738): n is a, c, g, or t
  misc_feature (2203)..(2203): n is a, c, g, or t
aatatctagtcctgtagcaaatttggaaaataaagaaaggtataaggaagaaaattaaaatcactcctgagtctatcccacgttcatagccaccactgaggctgtagtcctttgagcataaatgtatattcagcaacattaagctcattctctatgattatgaatctgcatttttccaagtgaaaagagatgtcatgaattgaaaagatccttccaaagcaccattgctaatggctcttccagttgtcacagatgtgtgacatttgtcgcctgttccccccacttctgacttatgatactgcagttgttcgcatgtttccctcttgtgaataacgcttcaggaacggcctcatcatctcaaagctttgctcttgtctttaggacgctgccctgtgagccgctcgcccagctactttgcacagcaagacatcaccttgtagctgttcttgagcggtgcactggcatccaggccagtagtgtggttgcctcacccccagctcctcctacaagttctagaaggcctctctctggttcagctcttggcagctcagtaaagataagacctgcccacagccctggggatgggcggagactgggggattagaggagccagaggtcacctccaactgccatttagctcttagtgggctcttcagctggatctggaaaccagattgacagcaggcagattaataagaatagcataccaattgtattggttttacatatacatggggatcttctgcaagagagcgaaatgcaaagaagtgacccaagcaagacgcttttgtactttttgacaaagaatgataaatttgaaaagaaacgacagggcaaagaaaatctggctaggacagtaaattttctagtggagtccctaggacatatacaggtggtgtaaagcagtggaagatgagggctactccattatgtatgtttactcaggcccactgcagcctccagtgcccagcctctggtgacaagggccattttcttgccctggtgcagagaggggaccccttccagaggcatctctatcactggctgcatgtaggaagcgacaggtcagctcaccctttctgaaactatagtttctccaatgtttcaacatgatatagtcagtataatcaggcatatgtgaggatggcctgtccttcactctttcagaggcatggaataatatactttttttttttttgagacagagtcttgctctnttgcccaggctggagtgcagtggtgtgatcttggctcnctgcaacctctgccncctgggttcaagcgattctcctgcctcagcctcccgagtngctnggattacaggcgcgcgccaccacccccagctaatttttgtatttttcttggagatgggatttcaccatgttggccaggctggtctcaaactcctgacctcaagtgatccacctgcctcagcctcccaaagtgctaggatttcaggcgtgaggcaccacaccaatacacttctcaaactaggggggcttgtacccactgttacacgggccccatgcttgtgtaatgttctgctgtcagcacccggagactctgaatcattttaaacaaggggctctttgtcattttgcccggggtctcacagcttacacagtgggttccactgacttgagccgtcctcatccttagagaccttcaccttttagacctcagagctttgctgcctttaaacaaagacaccttgtggtgaaaacccccaggcccagtngcgatttcctggcttcctcaccttgatggcacagaccaggggcagattctggagtcctggcagctcaactgggaacggggatttggctccaggaagtgttcattatttatgaacctccaaatcctaaatccatcagtggccgtgtgtggccacagtggggcaggctggccggcagcccagctgctcctggaatgagcttagagtcacccctcccggtggaggcagaagctcgctgggcccccagcgcggctccacgcccctcctccaggtggcttgggtgagagcctctgtcctgtgaagtaactgccaaaaactgccagatcccctggagccatcgtccgacccgatggatacccacccactccacccagcccagctgctcccttcacctttttaaccctgagaatgtgctcagaaggttccagcactgcagtcctcatgcaggaagatgagctgccactgggnatctccatccagatgccactgccctgggatgggccccacctgggtcaggcgcccagggacccagctgcctccaccacttctgtgtgctggtcacttgtgcatgtggtcacaaggtgcctggccctccatgtctctgaaagagcccgtcactccttcgcgatggtgtgctgagatggcaagaagccgtcttttatagaaactgtctctgggccgaaggccgtgggtcatgcctgtaatcccagcactttcagaggctgagaagggtagatcacctgagctcaggagttcaagaccagcctgggcaacatgatgaaaactcatctctaccaaaaatacaaaaaaattagccaggtgtgatggcacatgcctgtggtcccagctactcaggaggctgaggtgggtgtatcgcttgagcctgggaggcggaggttgcagtgaaccaagattgcaccactgcattccaacctgggtgacagagtgagaccctgtca

SEQ ID NO: 2455 - DNA, 194 bp, Homo sapiens
caaggctggggaagagaatagttagcaaaagaggcagaagtggacccattgttagaatgatgaataccagaggttgggaaggacgtgtgtgtggggtgcggggaatgaagaaaggctggtcaaacgatacaaacatacagccagatggaaggactacattctaatgttccatagcaaccatgaactgtatactt

SEQ ID NO: 2456 - DNA, 314 bp, Homo sapiens
aggatgagctggcccttcttcaagtcaagtctagccccctcaccctgtccacacctcctcaaaaaacagctccaaagtctcctggtctcttttccctctatcattcccatctgcacacaaacatgctataatttctcccatcttataaacatcccactggaactttcagaagcattttagattctccattttccttaaagttcactattcaccaaactgcaaaatatctgtcgctctgtcacctaggctggagtgcagtggcgtgatctcggctcactgcaacctctgcctctcagcttcaagcaattctcgtg

SEQ ID NO: 2457 - DNA, 368 bp, Homo sapiens
ggattttcagattagggatgctcaaccaggaagtataatgcaaatattccaaaatccaaaggaaaaaaaatctgaaattggaaacgcatctgatcccaagcattttggataaggggtactcaacttgtactaccgtaacatactacatacttttagaaaagaataaggtgaatctagatgcactgatagagtaggtaaattgttgaagtctaaaaaacaagtgagagaacactgtaaatagcccagtctattggtgtcaacagaggtcctcttggaagcaaggtaattttttgaaagatgcaaagaggtagtgagaggggtatcaagagagtagagggccaggtgaggtggctcatacctgtaatccc

SEQ ID NO: 2458 - DNA, 426 bp, Homo sapiens
ggtagagacaaggtttcaccatgttgcccagactggtctggaactcctggggttgcaggcatgagccaccatgcctggcctgactatactacttaagggtcagggacttcaacaatttcctgttgaatgcaggaaattgcctggagctcagtaattaaatgctacctgcgtgtttcctacttaatggcattctggtggtgagcagtgacgtagcccataatatgagggaaagcagggagatggttggagatgtaggcgttaaacgcttaatgaccagcatttctccttgatgtgcctagagcaaaatgattcagtttcatctcacccacagcatgcctcttaaatacgcatcctcaaagaaaaatgaaaggtaggaagtagggaaaacccaaatcacagcagagaaactggaaacttggtgaggtt

SEQ ID NO: 2459 - DNA, 432 bp, Homo sapiens
gagaactgctttctggcttctctctttcacatcacactgaaggcccacacaagtggtacttggaactgtgcaggagagaagactctttggtggaagtaaggaggaggatcacctgctcacgtttgctaagggcatttgcttgaaatgcgtgtgtgggagggagtctgtcttcaaacctagacacaaaagagattttatttgctttcatgatttcttttctctcccttctcatatttttactccaaagtgtgtgcaaattattcaagcatctgggacctaatgcaccatcactcactgcagcttttattaaactttgtgccattcacaactgaatagcagtgaagttaattaatggccaaattagttggaagttatttggaatctatattgcatcaatttctatgtttttggcaagaagaatagaaaaaagaa

SEQ ID NO: 2460 - DNA, 336 bp, Homo sapiens
gcagaccacttgaggtcaggagttcaagaccagcctggccaacatggtgaaaccctgtctctactaaaaacacaaaaaataaaaaataaaaataaacaaataaataaataaataaataactgagcgtgatggcacacgcctgtgatcctagctacttgggaggctgaggcaggagaatcgcttgaacccaggaggtggaggttgcagtgagctgagatcgtgccactgtactccagcctgggtgacagagcaagactctgtctcaaaaaaaagaattacatattatagaaaacacataagaagctgaattatgaattgtggtctataatatatagt

SEQ ID NO: 2461 - DNA, 1197 bp, Homo sapiens
taggtaagaagtagtagggtcctaagttcaagggttggtatcaggaatggaaaggatcaaaaagtttccagagactgtgaaggacagaatgactcccttacttatgtcactgcctcttgggtagagagatgtttatcatgacaggcgcctacttcattagatcagatcatcatccttggcaaaatgtatatcggtggataaattagacctatacaatactgttaggacaagtggatgcttcttttagcaagagtttggccctgggagaacgtatttctgctcagatgaaaaaccattaatttgagagacagcatacatagtgaaagacacctgggctttggacaacaaaagtccctttgataaagtccaaatacctcataatacactatattgtctaaattacttactatctgtgagccttactgtgttcatctgtaacatgggatcataatatttaccttgtataatggtaagttttatgtgtcaacttggctaggtcatggtatccagatatttggacaaacattagatgtttcagtgaaggtattttttagatgagattaacaatgaaatcagtagactttgaggaaagctgattactcttaataatgtgtatgattttcatccaatcagctgaagaccttagtagaaaaatgctgacttcccctaagcaagaaggaattctggcagcaaacagccattgacttgcagccttttccctagacctgcagcccgcctacctactctgaagattttggagttgccaagcctccacaaccatataagccaatacctttctctctctttctctcttttctctctcttaaactgcaaaaagcaaacaaacaaacaaacaaacagacagcaggttcaaaatggagtcactcatactagtgtcacataaccaaaccaaaacttgcgttatttacttgcaagatttgaccttgtgagaaatcagaagagagataacagtggaatccaactaggccaacaagattttgcttacatctgtagaagaaaagtaaccttgaaatgaccaaccctctatttgttctttatttctgcttttctcttcttttttctgcccataaaactcacccactctgtttagctcatcagagtttctttctactttgtagactggatgctgcccagttcatgaatcgctaataaaagccaatcagatatttgaaactc

SEQ ID NO: 2462 - DNA, 760 bp, Homo sapiens
tgaagcagctactcattgctttttccttttgctgtgaagatcatggattgggaatgtcctcgtgaggtggacctaaggcagtaacatttaaacttcatgtcctagcacccgccctccatctgacccaaagataaaaaaggcatcaagcttcatggttatgcctaagcttaaaaattcccttccccactactaatattgagttcagcagggccccatcttacttatttttcaaaaaagttatagctttgaattatagactatattactaaatttggtaaggtagttctttgcatgaatgggaatgtgtgtcaaaatactttcacaaaaggcatgattacaatggaaatgcccctttgcctccagttttgctaaccctaaaaagtatttcactaatttcaagcactgtttacactcaaatcccaaaattggccaaattatataattctcttaaattttcatttctgtaggtggagatttaactatggttctggtgaatcatagaagggagagacaatatttgaggggagtttatcagcagaatatcatgccttatgaccccattactgaaacacagacattacaatcagaaatagacctaataattccaatatccctccattaactagttccagtgatgctgaggagacacagcaccctgtgccagggtattcaggaaatattaagcctcaggcaggaggggtaactgaaaactttcaatcagaaacactctccaaggcttatggctagattatgtaggtca

SEQ ID NO: 2463 - DNA, 351 bp, Homo sapiens
gtctagataagcccagctttcctggtacccttcatcacctggcagacagacagccccatgccaaccctggacattacttgcttttgaacctttcctttctcaacaaccatgaacttcaaatgctttctgtctcaggacactttagaataacaatggaagccatcacttattgagcaccccttatgtccatttattcaaccaatgattatttagggatctcttattgagcaccaggcagcatcctgggtgcttggtgcagcaaggaacaggaccaagtctctgcctcatggggctgacatcctagtgggtgagaaagacaataaaccaataaatgacatgccagttatttgc

SEQ ID NO: 2464 - DNA, 258 bp, Homo sapiens
gcacgaggagaaaggaaaggttcaaaagcaagtaatgtccaggacactttagaataacaatggaagccatcacttattgagcaccccttatgtccatttattcaaccaatgattatttagggatctcttattgagcaccaggcagcatcctgggtgcttggtgcagcaaggaacaggaccaagtctctgcctcatggggctgacatcctagtgggtgagaaagacaataaaccaataaatgacatgccagttatttgc

SEQ ID NO: 2465 - DNA, 448 bp, Homo sapiens
attatatccattattgttttgaacatggattctatttttctgacattaacataacagctttgagacatcagtatttgcatgacgtatccttttcaccctttaattttggaccatttttatgattttataaattatttcatttataataagtatatgtctggattggctgggtgtggtggctcatgcctgtaatctcagcactttgggaggctaaggcagacagataatcagaggccaggagtttgagaccagcctggccaatatggtgaaactccatctctactaaaaatacaaaaatgatccaggcatggtggctcatacccgtaatcccagctactcaggaggctgaggcaggagaatcacatgaacccaagaggtggaggttgcagtgagccaagattgagccactgtactccagcctgggcaacagagcaagacttggtctcag

SEQ ID NO: 2466 - DNA, 563 bp, Homo sapiens
gcggccgccggccaggatcgagccctggcccgggccctggcccagccccggcctccaaggaccgcgccgaaggaggtgcccactggagggaggaggcgctcgactttctcaggatactgtccctctcccacagaggagctgaaggagtaggacagaagaactgtcaaattctggaatccttaaagccatgtccaaggatttggtgacatttggggatgtggctgtaaatttctctcaagaggaatgggaatggctgaaccctgctcagaggaatttgtacaggaaagtgatgttggagaactacaggagcttggtatcattgggagtttctgtttctaagccagatgtgatctcattattggagcaaggaaaagagccctggatggtgaagaaggagggaacaagaggcccatgccctggtgagtgagagagaaatagggagacagaagccattgccaggaaaagctcagcaattctgaaagatttcagttcataattgacgtttcctgggtagctcttcttaaagactcaaagcctgggaagaaatattgaggcatctttag

SEQ ID NO: 2467 - DNA, 558 bp, Homo sapiens
ttgagacagagtctcgctctgtggcccagactggagtgtggtggcgcgatcttggctcactgcaagctccgcctcctgggttcacgccattctcctgcctcctcagtagctgggactacaggcgcccgccaccacacctggctaattttgtgtattttttagtagagacggggtttccccgtgttagccaggatggtctcgatctcctgacttcgtgattcgccagcctcggcctcccaaagtgctgggattacaggcgtgagccaccgcgcctggcccgtatgttgtattcttaagatccaaagcatgtgggaaaaagaattgtaaatttagatataaatgaattgctcagtgatacctctaatttactcctgaggttggggaaagaaggagaaagagaaggaaaggtttctaggctgatgatactgagagctgcagggcaggcctggcattttatggtttcttttccttctccagctcgactttctcaggatactgtccctctcccacagaggagctgaaggagtaggacagaagaactgtcaaattctggaatcc

SEQ ID NO: 2468 - DNA, 208 bp, Homo sapiens
ttctcaggatactgtccctctcccacagaggagctgaaggagtaggacagaagaactgtcaaattctggaatccttaaagccatgtccaaggtaaggaagcatttcttctctcttccctaaaatgccatcttattttttaggttatacgaacattttgtttttcttccaaaattctgcaacctaataaggttccattcatccagtgac

SEQ ID NO: 2469 - DNA, 706 bp, Homo sapiens
gtgagattatccaggcatgtacttggatatttagggcaaaaaaatcatagcaaatactttactagtgcctactatgtgtcaggcactgtttctggtggataataactcctgaggaataagcacaacactgtggagtagtcaagaaggtaggaagaaagcctggagtttctgcctttaaaagggagcaggccgggcacggtggctcacacctgtaatcccagcactttgggaggccgaagcaggttgcaggtataatttatataatcgggagtttgagactagcctggccaacatggcgaaactctatctctactaaaaatacaaaaattagtcaggtgtggtggcaggtgcctacaatcccaggtactcaggaggctgcggcaggagaattgcttgaacccggtgggcagaggttgcagtgagctgagattgcgccacttcactccagcttgggtgatagagcaagactccgtctcaaaaaaaaaaaaaaaaaaaaggaagtggtaagttacagtctacggagaggtcaagagaactgactgaaagtgtccgtatgctagagcaagtaggagtcagcggtggccctttatgagagtcactttagtggcacaacagggatggaggagtgaaggtgaggtgaataaatttagactactcttaaagcttgggggtaaagggaaggagagggagcgctagttaggaaagg

SEQ ID NO: 2470 - DNA, 226 bp, Homo sapiens
aaaccctataggcaaattatatgtgtatcatttgtatataattgtacacaaatatgtatatatctgagctccaaaatgaagccatttgaaattttatataaaatttaggaacaaattaagtaaatgtatgaaataattaccattattatgaatttaaaaatgcaaattaaaatgaggtggcattttttttgtacacatcattagcactggaaaaattagtgatggt

SEQ ID NO: 2471 - DNA, 384 bp, Homo sapiens
caaacatgcacatgttcacagcagcgttctttacaatagcaaaaatgtggaaacagctcacatgttcatcaatgagttaatggataagcaaattgtgggatgttcataaaatgaaatattactcagctataaaaaaggaatgaagtactgatacatggtacaacatggattaaccttaaaaacaggtgctaagtgaaagaagacagaagctatcacatattttatgggaagtgactgcttcatgtgtacaagttttcttttgagatggtgaaactgttttggaattagggagagttgagctaagacaacattgtggttatagcaaatgccactgaattgcatactttaaatgggtaattttaccatatatgaattttatcttca

SEQ ID NO: 2472 - DNA, 264 bp, Homo sapiens
catggtctgggtcctcttttctctgagcttctgcgctgtcctcctccctttaccagccagcttcttcacaccctactctgtatcttacaactcaaagtgcggtccctggaccagcagcagaagctgcagcagcaactgggttccacctcagacctatttattttaatgagatcgcagggtgattcagatgcacattcaagtctgagaagcgcggctcggaaccatctctgcttttcaagcctcagcttgtatgtggctttgacg

SEQ ID NO: 2473 - DNA, 310 bp, Homo sapiens
aactcacagtctaaacaaatacgagacaaaacatggaaggcaataagctgcaattaaagattttgtttttggaaatggtcattaggcttaaaaatagtcacagggtcagtttttcacgaagccaatgcagggtaaaaggctaatctcacttgtaattcttagcagctctctcactgatggtttagttacttaatctccttggtgtttactgtgtcgttccttacgggtgaagaatgggagatgaacgggaatgctttgtctaaagcacagaagagttgctggaaattttaagactcaccagtcaggcaac

SEQ ID NO: 2474 - DNA, 867 bp, Homo sapiens
ttcaatatgatcaggaattcctgtttttagctagatatatttttccaagcctcccttagatttaggtatggctatgctaactaagcgttggcacgtaagatacaaccagagtagtgtatgcaacttctgagaagtcctacagaggggtaaggagatgtccttctccatttctccttcctgctggctggaatgcatacattgctgctggagcaaccctcttggataaagtaggaagaacaatgagatgaaaagacattggttccagatgatcacagagctgccttcccatccctgaattgcctttatttattaatacatgggataaaaataaaagttccatcttcctaagccactatatttttgggttttaggcacttggagccaaaacaaattctaatggatacaaaattaagaagtgaaaccacagaaacatttttgtctgataaatggtgggagaggcaaatcctgaagagtcggcagagacttttaaaacactagcataatctccctagggaacagaatgaatagacttcttcattggtgcagacatagtaagatggaggctgagactaaagggaggctaaaaccaaaaagccattcagccattggcattcaagttctgtagggaaatatacaccaagtcataggaaatcaaagtcccaaccttcaaggaatgactctataatgagaaacatcaggtcagcaagggcagccgcatgaaggtgttctaactttaatatgcaaaaactctgagaaatctagagccggaggacaagaggaaggactttcctctaggcttctcccctcatcagttccagttttaagtcacaccttttcacaaggcaatgacagcaaggccatttcagt

SEQ ID NO: 2475 - DNA, 318 bp, Homo sapiens
cgagttgctaccatttctactgccttctttagctgccctcaccaccccgctcagagtcctacaccgcatcctgggatgttgttgtcactcaacctccacctggataccttttgtcacctgctttggttctgacaacccatgcagggctgctgcttcattctcccctctcctctagtctccccatccctttgagatgtcctcttcaccccacttgggtcctggtagtcgtatggacaccatccttatcttgctcaggttgtgatcccctgccctggatcctcacttccaccaccttccacgtggatgccctttccatcc

SEQ ID NO: 2476 - DNA, 791 bp, Homo sapiens
tttctgctttttttttttttttttttttttgatagagagtctcactcttgcccaggctggaatgcagtggtgcaatcaaagcccactgcagcctccaccccctgggctcatgcaatcatcctacttcagtgtccactagtagctgggactacaggtgcaggtcatcaatttttgtatttttgtattttgtattttttatagagactggggtcccactgtgttgtcagggctggtctagacctcctgggctcaagcaatccttctgcctctgcctcccgaagtgctggggttacaggcgtgaaccacagctcccagcctctgcttttgttctacacagttcactccttccggggcaaggcaatggctctgacactgctgcaggacttcatggtgaattccttatttggagggacagcataggggccgccagaaaatatcgccatggccagaagcagagcaagggagagagggttttaaaaggcagggctgtaaacctcagcataaaataagcagccagcctctcatttcagtcatgtaaacagtaatgtgtattcattaaaactgcattagtctaaggagtccccagagatcaggggctaacgggagaaggggtaggggagaggctgccaactgcacctgctgttttctaacacagtgcaaacaggccaaaagtgggtttctggtgcatgtcacagccagaaaaggctgcccagaggggcttcacagcccccatccatcttgttaaaggtaaacagacatggagaaaacagaagcacccaggaccccaaaca

SEQ ID NO: 2477 - DNA, 782 bp, Homo sapiens
atgctaatcctgcacattttgttatcaagataagttattctcgctatagctcaggatttttttttcacctcttaaataaacatgttagccaggcacagtgccttatagctggaatcccagcactttgagaggctggtgcagggagatcacttgagaccaaaagtccaagaccagcctgggtaacatagcaagactccatttctacaaaaaaatatatatatttttttttaattagccaggcacggtggtatacaactgtagtactagccactcaggaggctgaggcaggatgatcatttgagcccaggagttcaaggttacagtgaactatgattgtgccactgcactccagcaagaccctatctctaaaaaaaaaaaaaaaaattaattagactaaatggcctctaaatccctaatctttcttacctctaaaaactatagtttctacaccatgtaagtatcttgtgattactttgtagatccttacagaacctattagataacaatactcagtgtaaaagggaagacaatgagggaccacaaatttatatttttatgatttgtaaatatgatttatttaatgacttgttttataaatagttttaaatactaaatattttataatgaatgttaatgttcacttctagtctccttgttacatattaatggagattttactgccttttccattagtttatttatgtcatacaggcataactcgttttatttgctttattgtattgtactttgcagattgccgtgttttaagaaactgaaggttt

SEQ ID NO: 2478 - DNA, 713 bp, Homo sapiens
cggtgtctgttggcagctagggcgagcctctgccacttcacctgtgatcctgggcaagttccttatctgctttgtgtctccgtctcctcgtttgtaaagttagagctgagaggattaatttcgcacatataaagtacttagtgcctggtacagggtaagtattctgtaagtattagctatttggtctattttgttggagtaaagtgggttatagttaaaatcctaagatttttaaagtccctcaagttcatgtggacatctgcctaggtcctactatcctagaattcgcatgtcttatcacacaaataactgattcttccatatcttataaataaaggtttgatttagcaaagtcacatgttgtgtaatagctcgaagaagccctttttgtccacagttgccagagcttttggagaacagtccttatgttattgaaacaaacctaatctgtagctgagttgggagggagctaagtggacagagagtcctccacccaaacaaaagaatctttgattcttgggcataatgggagcaatatttaaaaaaaaaaaaaaaaaaaaaaaaggaatgtttggggaagactcttgcggtgcaaaggctgtttcagattgctgagatcagaccttaagtaccaaagcccaaatatagtacaacataatacaaatgagaagaaaatagctgaagaataattcgagtttatacagtacaattca

SEQ ID NO: 2479 - DNA, 519 bp, Homo sapiens
agactttttagtagcttccaactacaaaaaaagagaaataatcaattatgtactaatcagacacttttaaaaattacaacagtttattcagagaaacaagctttgtgtgacattctaagcggattttattctgcaggtccttttaacataatgagtaatatttgtgttgggaatgactgagaagaaatttcataatgatgtgaagatctacctgtaaatagttcctctgtcgtatgctggtatttatattctagcatctcaacagtgctgatggtcactcatcttggagttccctgaatttttttttttttttcaaaactcctgtaatgttacattacccatacttttgttgttgctgctgttgttgttgttttgagacggagtgtcgctctgtcgcccaggctggagtgcagtggtgccgcgcccggcacatgactgcatactttcaaggagaggactcagagcttttatttatttaaagaaacttgaaaggaggaaagtggattaagaaaaaaaaaa

SEQ ID NO: 2480 - DNA, 746 bp, Homo sapiens
ccagtgtcttagggtatgtgtgtgtgtgtgtgtgtgtgtgtgtgtgtgtgtgtgtgtgtcttacctaaacactgactttttctctctctctgtcatgaacaagaattgagaggttaaatgggaattgtctcatgaattgtctcaatgttttctaagttgaatgaagaatcttttttggtagctattcttaagtgaatgctggatttttattaagggaagctaacagatatttaaaagcaccctccatatataaaagcacaatccatggaagcatagtgcaaggaataatgatatagacaaatggaggaggggcaataaaaagtcataaaacaggcaggtagaggtttctggaaaaataaggtggtgagggaagagtctaactgtaaaagtaaaaaggtagaagatagaaccgttgaaaaaaaaaagaaatatcagaaatataaagagaaataaacagcaagaagactccgtagtaatttaagaagtgaaaacttttaggacagaggtaggagagaaatgggaaacactggagaggaagtaacaactaggaagtgtggaagaaaaacctgcaggccagaaatctgagcaaagacttgagagaggatgatggtaaatgtgaaacattgaaagggatgttttaagggattcagacattgagaggaaagtaaattttcatcacaacaccccatgacgacaggctcaacacatttggattatgagaaaggaaattaacatggttagaacga

SEQ ID NO: 2481 - DNA, 606 bp, Homo sapiens
ccagtgtcttagggtatgtgtgtgtgtgtgtgtgtgtgtgtgtgtgtgtgtgtgtgtgtcttacctaaacactgactttttctctctctctgtcatgaacaagaattgagaggttaaatgggaattgtctcatgaattgtctcaatgttttctaagttgaatgaagaatcttttttggtagctattcttaagtgaatgctggatttttattaagggaagctaacagatatttaaaagcaccctccatatataaaagcacaatccatggaagcatagtgcaaggaataatgatatagacaaatggaggaggggcaataaaaagtcataaaacaggcaggtagaggtttctggaaaaataaggtggtgagggaagagtctaactgtaaaagtaaaaaggtagaagatagaaccgttgaaaaaaaaaagaaatatcagaaatataaagagaaataaacagcaagaagactccgtagtaatttaagaagtgaaaacttttaggacagaggtaggagaggtttctggaaaaataaggtggtgagggaagagtctaactgtaaaagtaaaaaggtagaagatagaaccgttgaaaaaaaaaagtaatatcag

SEQ ID NO: 2482 - DNA, 342 bp, Homo sapiens
cttaggttcatcatattatgttactgatataacacaattaacttggtaaaagtgaaggtgtgggtgggcgtggtggctcacgcttgtaatcccagcactttgggagtccgaggcgggtggatcacctgaggtcgggagttcgagaccagcctgaccaacatggagaaaccccatctctactaaaaatataaaattagccaggcatggtggcacacgcctctaatcccagctactcgggaggctgaggcaggagaagcgcttaaacctgggaggtggagtttgcagtgagctgagattgagccactgcactctagcctgggcaacaagagcaaaactctgtct

SEQ ID NO: 2483 - DNA, 428 bp, Homo sapiens
aaatcatagtgaatacattgcgggctttaatgtaaatatgaaaggcaggcccacttagagacgtggatgccaactcgacgtgtgggagtcgaaattgcggtgtggcttgcaatgcagccccacagccatgcagagaaagcgtgcgtgtggcggggttgaagctggctacactggctgacagcaccccacagcggcctgcaagcgcatgtgggagcttgggatcactaggcagcctggttcccactcctttatggcatcaaaagttaggtttctctacctcctactctcttcatttgggtctttgtaagaaagcaaaaacagcccctaccaccagtggtgcccagggtgggtccattgaagcaacgccagatgcagttggttttccagcctctgttcctgcaccagtgctgctgggcgcacccctgccc

SEQ ID NO: 2484 - DNA, 403 bp, Homo sapiens
gactaaaaaaattcatatgccttttgactcagctattccatttcaaggaatttaccctaaggaaaaaatgatggtttttcataaagccttagtcccaaaaatgtttgacagtgcagtctataatagaagcaattaaggaaattaaatgcccgtaaaggagagattggttgcaaaagttatgctacactagaaagctgatttttctccatcacagccccctcattactttcagagcacttactatgttaatcgtgtctcctgcagtaaactccaggaaagcagggtccttgtctgtcttgttcgccattgtatacaccactgtctatgagctggcacacaacagacactaatgaatatttaaatacatacaagacagtttacgtagtatgattccatttttgta

SEQ ID NO: 2485 - DNA, 462 bp, Homo sapiens
ccaggttgcctttatatttcctgcatttttctcctgttgctcttcagagaagctgtatgatataaatgaatgaatgaatgtgtgtgtgtgtacacacacatatatctccattcaaaagctatagcacatgcatgtttgtgtgtatgtgtatatatgtgcatgtatataagtatatatgcatacacacatatacacacacacaaaggtacagaaaatatatatcttgtgactaaaattccctgaactaccagtaactccagaaattctattctggaaaacaatggctaacatctaattcattatcttagaattatcacaaaaggaatatgaaaatgtggtttctagtgcaatgcagttaagataggtattcttgtaggccatggttccaagaaatttgtttgacaactgtactgagtagtatatttctccacttcctttatttttttcccttaccttttttga

SEQ ID NO: 2486 - DNA, 321 bp, Homo sapiens
actgaagcttcagaggaggccctctgcatttatcctctgactttctgtgaagaaggtgcccagtgttgaggcaaaaggaagattaatcagacttcggcagacctcaagcatcaaaatgttctgtaaaagcagagggaggcagctattgcactggctattacaagaaaatacctttgaaaaaactatttgtcaggacaaagccacctaaatcctcaagctacagctctcagcctaaaatagtaaacttaaaaattatttcagctaaagttaaagttactctcctatggaatgtcaaaagaaatgtgttatacagacattagg

SEQ ID NO: 2487 - DNA, 2939 bp, Homo sapiens
  misc_feature (2176)..(2176): n is a, c, g, or t
  misc_feature (2217)..(2217): n is a, c, g, or t
aacggactttttcagagagggaactatctctttgacacaaaacatacgttttaattaataatacttgctctggtaatatagtttcttatgagttgctacatattttctagaatagattttccctaaaatatgcctttgtaagatttttttaataaaatcaagtttagaaataatttgaacttttttgggggatagagtttcagtcttgtcgcccaggctggaatgcaatggcacgatctcagctcaccgcaacctccacctcctgggttcaagtgatttttctgcttcagcctcccgagtagctgggattacaggcacgcaccaccacacctgtctaattttggtgtttttagtagaaacggggtttcaccatgttggccaggctgatttctagttcctgacctccggtgatccacctgcatcagcctcccaaagtgttgggattataggcgtgagctaccgtgcccggcctgaacttttttttttttggagacggagtctccctctgtcgcccaggctggagtgcagtggtgctatcctggctcactgcaacttccgcttcctgggttcaagcgattctcctgcctcagcctccggagtagctgggattacaggcactccgccgccatgcccagctaatttttgtatttttagtagagacgggatttcaccatgttggccaggctggtcttgaactcctgacctcaagtgttctgccaccttggcctcccaaagtgctgggattgcagatgtgagccacgtcatctggcctggcctgaacttttagaattcaatattaaccattttcccctagtttattccctagagctcttcacaaagtatggcttgacttctctgagacagctagtgataagaaaaatgaagtttattttggtataccactcaaaaagattgtgaaaacaaaatggagattaattttttttttccaaactctttgtaccacaattttaagttgaatagctgacttcctaggcatggataagatcagttctatcttatcttctgtcctagtaatgtgtctgcagtggaatccccattgcttggcttctataattgatcttgaaccttcccaattatcattccctgaaaaaataattctacttaaataccttcttgacttaaatgtcatgagttgctacatctgggttctgataagatttttctaagaaaaactacatttgacatgtgacatcttcaggaattcaatatcttgtttctttgacagagggacgctattcatgtctgtgaatttggcagtctttgaaatgccatgtcttttttggaaaaagcttttgatggactttattttgatatacatcttaaggtcccctgacctatactataagcagagcatagcaaagagggtcattatgaacattgtgtgtagttctgggcagggcttgggatcctttgggattgttggtatctacaccacatggccccaccctgctatgttttaaggttttctgctgactttttaggtcttcagccttgattttgatgctttgagtgcctgcctctagcagcaccacccccagcccttttccagttggctgcatctcatctgttgtgggctaagaaaccagatcacagagcttattaaaattgtgtctaaaataagatccagtaggctcttgactgaagagggcttcatgtgctctgtgaactgtgtggtttccttggctgatcggagacctttctgacttgcttcctgtttttcttctttacttttgctatacagatgtaggaggctttttggtgctcttagagtgctgtaatgttgaagtatttggttaatttctctattcttgggaagggtaaaaggctaaataaatatcttgattctttgaggagttgaagactgaccagagttggatactaaaagcttttcttaacagtaatagtgcattgtacattttaatggtgtcctactagttgcagataacgtttggcatacatagctttcaaacaaagtaatgccaggattatcacttgatctatttctgtgatagagattttttttctttctttttttttttttttgaggcagtcttgctcaggctggagtgcagtgtcatgatcttggctcactacaaactctggctcccagggtcaagcagttctcttgcctcagactcccaagtagctgggattncaggcactcaccaccatgcccagctaatttttgtatttttnatagagacagggtttctccctgttggccaggctggtcttgaactcctgacgtcaggagatccgtccgtctcggcctcccaaagtgttgggattacaggtgtaagccactgtgcccggcctatggctagcttcttttaaggcgtctcaagacaaagttctcaatgaaataaagatttcaggtcatgcacagtgggtcacgcctgtaatcccagcactttgggaggcccaggtgggcagatcgcttgagctcaggagttcgagaccagcctgagcaacatgacgaaacatggtctttacaaaaaatacaaaaagttagctgggtatggtggtggatggctgtggtcccagctaggtgggaggctgaggtgggaggatctcgggagcctgggaggtagaggctgcagtgaaccgtgatcaggccgctacactccagcctatgcaacagagtgagaccctgtctcaaacaaacaaacaaacaaaaagatttcaaactctgatgtctataaaagccaggcaggtaccaaagtgagcagagagaacttgagggagctagaaaatgcatgtgctatcagatgagggcaactgctaaccagctccctgcaaatgttgctattgctaaaatctgtgggcccagtgttgcaatatcttccattcaaaaaaaaaagagaagccacaaatccagattttttggcaaccgattcaacttaaaaaaaaaaagaaca

SEQ ID NO: 2488 - DNA, 2360 bp, Homo sapiens
aacggactttttcagagagggaactatctctttgacacaaaacatacgttttaattaataatacttgctctggtaatatagtttcttatgagttgctacatattttctagaatagattttccctaaaatatgcctttgtaagatttttttaataaaatcaagtttagaaataatttgaacttttttgggggatagagtttcagtcttgtcgcccaggctggaatgcaatggcacgatctcagctcaccgcaacctccacctcctgggttcaagtgatttttctgcttcagcctcccgagtagctgggattacaggcacgcaccaccacacctgtctaattttggtgtttttagtagaaacggggtttcaccatgttggccaggctgatttctagttcctgacctccggtgatccacctgcatcagcctcccaaagtgttgggattataggcgtgagctaccgtgcccggcctgaacttttttttttttggagacggagtctccctctgtcgcccaggctggagtgcagtggtgctatcctggctcactgcaacttccgcttcctgggttcaagcgattctcctgcctcagcctccggagtagctgggattacaggcactccgccgccatgcccagctaatttttgtatttttagtagagacgggatttcaccatgttggccaggctggtcttgaactcctgacctcaagtgttctgccaccttggcctcccaaagtgctgggattgcagatgtgagccacgtcatctggcctggcctgaacttttagaattcaatattaaccattttcccctagtttattccctagagctcttcacaaagtatggcttgacttctctgagacagctagtgataagaaaaatgaagtttattttggtataccactcaaaaagattgtgaaaacaaaatggagattaattttttttttccaaactctttgtaccacaattttaagttgaatagctgacttcctaggcatggataagatcagttctatcttatcttctgtcctagtaatgtgtctgcagtggaatccccattgcttggcttctataattgatcttgaaccttcccaattatcattccctgaaaaaataattctacttaaataccttcttgacttaaatgtcatgagttgctacatctgggttctgataagatttttctaagaaaaactacatttgacatgtgacatcttcaggaattcaatatcttgtttctttgacagagggacgctattcatgtctgtgaatttggcagtctttgaaatgccatgtcttttttggaaaaagcttttgatggactttattttgatatacatcttaaggtcccctgacctatactataagcagagcatagcaaagagggtcattatgaacattgtgtgtagttctgggcagggcttgggatcctttgggattgttggtatctacaccacatggccccaccctgctatgttttaaggttttctgctgactttttaggtcttcagccttgattttgatgctttgagtgcctgcctctagcagcaccacccccagcccttttccagttggctgcatctcatctgttgtgggctaagaaaccagatcacagagcttattaaaattgtgtctaaaataagatccagtaggctcttgactgaagagggcttcatgtgctctgtgaactgtgtggtttccttggctgatcggagacctttctgacttgcttcctgtttttcttctttacttttgctatacagatgtaggaggctttttggtgctcttagagtgctgtaatgttgaagtatttggttaatttctctattcttgggaagggtaaaaggctaaataaatatcttgattctttgaggagttgaagactgaccagagttggatactaaaagcttttcttaacagtaatagtgcattgtacattttaatggtgtcctactagttgcagataacgtttggcatacatagctttcaaacaaagtaatgccaggattatcacttgatctatttctgtgatagagattttttttctttctttttttttttttttgaggcagtctatgcaacagagtgagaccctgtctcaaacaaacaaacaaacaaaaagatttcaaactctgatgtctataaaagccaggcaggtaccaaagtgagcagagagaacttgagggagctagaaaatgcatgtgctatcagatgagggcaactgctaaccagctccctgcaaatgttgctattgctaaaatctgtgggcccagtgttgcaatatcttccattcaaaaaaaaaagagaagccacaaatccagattttttggcaaccgattcaacttaaaaaaaaaaagaaca

SEQ ID NO: 2489 - DNA, 2307 bp, Homo sapiens
aacggactttttcagagagggaactatctctttgacacaaaacatacgttttaattaataatacttgctctggtaatatagtttcttatgagttgctacatattttctagaatagattttccctaaaatatgcctttgtaagatttttttaataaaatcaagtttagaaataatttgaacttttttgggggatagagtttcagtcttgtcgcccaggctggaatgcaatggcacgatctcagctcaccgcaacctccacctcctgggttcaagtgatttttctgcttcagcctcccgagtagctgggattacaggcacgcaccaccacacctgtctaattttggtgtttttagtagaaacggggtttcaccatgttggccaggctgatttctagttcctgacctccggtgatccacctgcatcagcctcccaaagtgttgggattataggcgtgagctaccgtgcccggcctgaacttttttttttttggagacggagtctccctctgtcgcccaggctggagtgcagtggtgctatcctggctcactgcaacttccgcttcctgggttcaagcgattctcctgcctcagcctccggagtagctgggattacaggcactccgccgccatgcccagctaatttttgtatttttagtagagacgggatttcaccatgttggccaggctggtcttgaactcctgacctcaagtgttctgccaccttggcctcccaaagtgctgggattgcagatgtgagccacgtcatctggcctggcctgaacttttagaattcaatattaaccattttcccctagtttattccctagagctcttcacaaagtatggcttgacttctctgagacagctagtgataagaaaaatgaagtttattttggtataccactcaaaaagattgtgaaaacaaaatggagattaattttttttttccaaaatcagttctatcttatcttctgtcctagtaatgtgtctgcagtggaatccccattgcttggcttctataattgatcttgaaccttcccaattatcattccctgaaaaaataattctacttaaataccttcttgacttaaatgtcatgagttgctacatctgggttctgataagatttttctaagaaaaactacatttgacatgtgacatcttcaggaattcaatatcttgtttctttgacagagggacgctattcatgtctgtgaatttggcagtctttgaaatgccatgtcttttttggaaaaagcttttgatggactttattttgatatacatcttaaggtcccctgacctatactataagcagagcatagcaaagagggtcattatgaacattgtgtgtagttctgggcagggcttgggatcctttgggattgttggtatctacaccacatggccccaccctgctatgttttaaggttttctgctgactttttaggtcttcagccttgattttgatgctttgagtgcctgcctctagcagcaccacccccagcccttttccagttggctgcatctcatctgttgtgggctaagaaaccagatcacagagcttattaaaattgtgtctaaaataagatccagtaggctcttgactgaagagggcttcatgtgctctgtgaactgtgtggtttccttggctgatcggagacctttctgacttgcttcctgtttttcttctttacttttgctatacagatgtaggaggctttttggtgctcttagagtgctgtaatgttgaagtatttggttaatttctctattcttgggaagggtaaaaggctaaataaatatcttgattctttgaggagttgaagactgaccagagttggatactaaaagcttttcttaacagtaatagtgcattgtacattttaatggtgtcctactagttgcagataacgtttggcatacatagctttcaaacaaagtaatgccaggattatcacttgatctatttctgtgatagagattttttttctttctttttttttttttttgaggcagtctatgcaacagagtgagaccctgtctcaaacaaacaaacaaacaaaaagatttcaaactctgatgtctataaaagccaggcaggtaccaaagtgagcagagagaacttgagggagctagaaaatgcatgtgctatcagatgagggcaactgctaaccagctccctgcaaatgttgctattgctaaaatctgtgggcccagtgttgcaatatcttccattcaaaaaaaaaagagaagccacaaatccagattttttggcaaccgattcaacttaaaaaaaaaaagaaca

SEQ ID NO: 2490 - DNA, 292 bp, Homo sapiens
tccaagagatccttctcagtagcaatttttcaccgtgctctgatggcaaacataccagcttctgtgcagacacttctaatctcagcagcagtgccatttggacacagtcgtgctaacaattcaaatctgatatatctttcaacactcattgaatgagcgtgaatcttaaagatgtgggtccgaccctctagatcaggcaagctaaattcaatttttctgtctaatctgcctggcctcatcagtgctggatccaaattatcaggtcagttagtggccatcagcactttaatat

SEQ ID NO: 2491 - DNA, 343 bp, Homo sapiens
ggaacacatgatgcgattactttccccaatccataaatccactactgcagcccacatctggatagatacagtgattcaaagtagaaaatgataccagttgagtcccttctcagtatttttcaagccatcgttcctgcattaaacaggtacgcccaattacaaataacaacagttaccatctacctatccccttctgtgggccagtatgagtgctagccacttaacatctttcatgtcatttaatccctagagcaactctgtaagaaacatatcattacctccatttaatagatgggaaagtaaggactcaaagaggatgtaaggctgctaagcggcagagcca

SEQ ID NO: 2492 - DNA, 288 bp, Homo sapiens
cccagggtgagtgggggtctctagcttgtcctttgcacctttttactccataatggtctcaagaggttcctggcttttccgtttgaggaggaagaatcatttgacaaatagtttttacctgcctggcgtgtgccagatctccatagccccaagtcccctggctccgccctctcatacccattgtcctagaatttgagagggcaggtgggaggggtgggactacttccactttccccaaattcttttgccttattcactgtctactgatgaggccagatccaggtttaa

SEQ ID NO: 2493 - DNA, 282 bp, Homo sapiens
ggaagaatggacagggggttaactgaaacatgtatgtctaaaattacaaaagatacaaaagggaggacaccaggggtacagacgggcaagtattgaaggtaatcagatacaatttctaaaaataaaaacactcacggaaactaacatctcagtggatggctgaaccacagattcttctcagccgaggacagattaatgtcctaaaaaaaaattcacttgaggaagttacccatcaggagtagagataaacacaccaattcaaacaataaaaggaaggctaag

SEQ ID NO: 2494 - DNA, 396 bp, Homo sapiens
gtgagacccgagcagcagtcgctctgttcttgtgatcatggctgagtgggatccagtgtgagtctccacccggcctgttacccagttccagctgcagggcctgggcgcccttttccgcctgggcagcagtgaatgaagttgctctaagtcccttgctgctcttggtgcacttaagagagggctcgcaggccacaggataacaggagaggctgagtgcgcggcatcctccatcatggaaacgcatctcgcaccagcacacgcagctggcttttccactacttttgcccgtcgatggcaccacccagcttttctctgggtgggacaggtatctgtccacctggggtttctactctgcatgttttatctttttttttttttttttcctgagatggagtt

SEQ ID NO: 2495 - DNA, 300 bp, Homo sapiens
gcccagggcagatggaccatagtgggaagccactagttcagggatgagagaaaacttagcagcaatgaaatagaaacgattgctggggaaggcagagaaggatttgggaaaaatttctcactgtcttatgaaccacacctcctccacccctcccatatactgccccatgcttatgagtatggatcattatgtaagaaaataaaatagtgaactatcggtattataaacatatcattatgtttattattattataataaacatatatatgtgtgtatgtgcatatatatatatttgacatg

SEQ ID NO: 2496 - DNA, 119 bp, Homo sapiens
tgtctgaatcctcagctgcagaggaaaacacaggtagtatgggagttccccccaagagttcacatttgaactaggttgttttttttttaaccgcaacctctgcctcctagttgcaagtg

SEQ ID NO: 2497 - DNA, 1790 bp, Homo sapiens
ggagatgacaagcaactgagatattgtgatatataatcatgctcttagcttcagctaaattcagctaaattcttgtacactgaaccaatgtcataatcaggcttatttagaaaacactttgaactatgctataaaagattatatcagaattcatattatacatgtgttcacatcagcgctacctgtgatgttttcatgtatttatgtatgtgttataaatacttgatttgtacatatacaaatgcacatacgtagtgtgtttgtgtgtttatgtataaatttataggcacacaataatagaggtaattataagtaggatgcggtatggaataatttgcttaaaatatgctaaataaccaaaactgtttaacgtcatgttcctgttagtgcttccatactccacgtggggtagggactacatcacacttttccaactctgtgcagtactgcatgggtggaagacatatttaagataatgtgcttcccaaaacaactgaataaaagccatcccactacattgagtgctttctctggctccttgcaaagaaagatactttttgtaatggtccaggaaaggaacattgctttctttttgtctttcagcacatttgtattatgctcaccttgtctctgtctcactgtgacccctttacacttgagttcagagttcaagcattccaaatataaattggaatgttggcagcccagtggcttgaaggccaatgatgagcagtccaagaccccacagcgagatgagcaactcttaggaattcccacatcctagagtgaatgcaccaactaacagtatagaatgctgtccttttcaaagcgtcctaacagcaggattacctggtcaagtatggactttctttgaatctttcttttcacaaattggactgcctgtaataccaataacattgttgtatctaactaaataaatgactgcatatacacacataccctcaattctcttgcttccccattttctttttcatcccctgtctcaggacttttattttcagtgttgacctttggtttggccatatatcactgttataggaaatctcatgagaggaatggctagtgaccccaactctccaaatgtctaagttagtagttacagctgattttttatgatgcataattggaatgtggagcctctgaggttgtgatagcttgtacatgaatttcaaatgtcattctaaagaatgaggggtgggagggatttatagttagaaacgacagtgcaggaaggggtattttcttgttgtcagggctggaatgaatcactgctgctcaagtcaaaggttcttgaatatccttagtttttgcatttcccctccttttcctttgacctttatttatttaattatgtatttatttatttatttatatacttttgctccattcagcacaaacacaaagcaaagcaaaaaaaaatatatatatatatatctgtatatgtgttgtaggcaaaacactgtgaatttcacaacaaccaccaccaagcaactattttgccatcttaacatacatctcaggagacgaaatgagaaaagatggggatgtcattttttagtctatgcgtttgaggccaggtccatgtttatttatttctttagtctatgcattaatgaaaatgatcctgagtggaggttagctgaacgttcaatgtactggagcaagcatcataaaagctgctagtagccatgtgtttgaacaggaaaaatattacagaaaatgaaatgtaaaggcctatatcttgcagcttgtatatcttactattgctt

SEQ ID NO: 2498 - DNA, 1814 bp, Homo sapiens
attcatttattcaacaagtatttattgaactcttatttaaaaattgatgaactgctaaatgttcgtataaatcttcagctaaattcagctaaattcttgtacactgaaccaatgtcataatcaggcttatttagaaaacactttgaactatgctataaaagattatatcagaattcatattatacatgtgttcacatcagcgctacctgtgatgttttcatgtatttatgtatgtgttataaatacttgatttgtacatatacaaatgcacatacgtagtgtgtttgtgtgtttatgtataaatttataggcacacaataatagaggtaattataagtaggatgcggtatggaataatttgcttaaaatatgctaaataaccaaaactgtttaacgtcatgttcctgttagtgcttccatactccacgtggggtagggactacatcacacttttccaactctgtgcagtactgcatgggtggaagacatatttaagataatgtgcttcccaaaacaactgaataaaagccatcccactacattgagtgctttctctggctccttgcaaagaaagatactttttgtaatggtccaggaaaggaacattgctttctttttgtctttcagcacatttgtattatgctcaccttgtctctgtctcactgtgacccctttacacttgagttcagagttcaagcattccaaatataaattggaatgttggcagcccagtggcttgaaggccaatgatgagcagtccaagaccccacagcgagatgagcaactcttaggaattcccacatcctagagtgaatgcaccaactaacagtatagaatgctgtccttttcaaagcgtcctaacagcaggattacctggtcaagtatggactttctttgaatctttcttttcacaaattggactgcctgtaataccaataacattgttgtatctaactaaataaatgactgcatatacacacataccctcaattctcttgcttccccattttctttttcatcccctgtctcaggacttttattttcagtgttgacctttggtttggccatatatcactgttataggaaatctcatgagaggaatggctagtgaccccaactctccaaatgtctaagttagtagttacagctgattttttatgatgcataattggaatgtggagcctctgaggttgtgatagcttgtacatgaatttcaaatgtcattctaaagaatgaggggtgggagggatttatagttagaaacgacagtgcaggaaggggtattttcttgttgtcagggctggaatgaatcactgctgctcaagtcaaaggttcttgaatatccttagtttttgcatttcccctccttttcctttgacctttatttatttaattatgtatttatttatttatttatatacttttgctccattcagcacaaacacaaagcaaagcaaaaaaaaatatatatatatatatctgtatatgtgttgtaggcaaaacactgtgaatttcacaacaaccaccaccaagcaactattttgccatcttaacatacatctcaggagacgaaatgagaaaagatggggatgtcattttttagtctatgcgtttgaggccaggtccatgtttatttatttctttagtctatgcattaatgaaaatgatcctgagtggaggttagctgaacgttcaatgtactggagcaagcatcataaaagctgctagtagccatgtgtttgaacaggaaaaatattacagaaaatgaaatgtaaaggcctatatcttgcagcttgtatatcttactattgctt

SEQ ID NO: 2499 - DNA, 360 bp, Homo sapiens
gcctcccaaagtgctggcattacagttgtgagccaccatgaccagctgagacatactttttttttttaaaaagaatcatttaaaagcatctctaaaaatctcttcttagatgagcttcacttccaatgcaaatattaatttttaagttagaatagcaaattctggacctagatggctctgtcacacactagctgtgtgactttgaataagttatttcacccctttttgtcccaaatacctacctaatttggagactcttgaattgttgattaaatgagtgaatgtatataaagtgttaagagtaatgcctggatgttgttccctgcaaaaagaaaaaagaatagtgcctagcctacagtg

SEQ ID NO: 2500 - DNA, 1829 bp, Homo sapiens
  misc_feature (1031)..(1031): n is a, c, g, or t
  misc_feature (1033)..(1033): n is a, c, g, or t
aacgaacagaattcttgggctggataaccagctgtcatccccaggttcctggataattccagcagggatgtgaggctctgggtgctgaaaaaagtaactagaaccgtaccaaacactcttctcacttccatctgggtgctaaggagcctagaggggagcaactctgtgtctagacacagtggcatctacctgggtttggagtctgataagccctgaggggaagctgtcaaaaagctaataatactgtgtgcttagccaacatgtgctccccacggggtttccaccgctgctctggaagttccttcctcagaaaagagagtcagaccctccttgtctccattccacggctctagagactaagcctggactggaaatcgcagccaagtggagttgtggggctagtcagagacgatgcttaggatcctgggactcgaccattgcccaggaacatctcagacagggagacatgtagccaggtttgcacaactctgcctgcgtgcgcaaccccagctgaaccccttccattgctacgtaaagaactcaagtggcttgaaggcttctaggacaggtttttaaatcccaactgtacgactccctagttgagtgaccttagccaagggaagtgggaaataaattattggatggctaaatgtgccaggcactgtgcttgcattggagcctgtctgaccccgaagcacaaatcctctctctgtgagcactcgtcctacactcagagccagaggccttaggctggaggcacagttatttgactctgggaagtcacttccatcctctctggacctcaatctctcttcaggcaaataggacagtcctgctgaccccatggggtgatggtgacattaaaatggaacagcgtggtgaaagctctctcatactcagcgtgtacgatctttgggaccatcacaaggaagtttttagaaatatagattgctagatgatgggtgagggtcttgacccagtggccctgagaatctatgtctaaaaaaaaaaaaaaaaaaaaaaaaaaagcncnctcaaggcaggtttgtgaagcagctcatgtttacagatgtaagggatgaatatcatttccccagacctccgggatgccaaaattttgcttcctcttccctgccccacctaaaacgttgccagtcccagccctgcccttggactctatctctgaaggtttttattttattccttcactgatagaatctggctgcctctcagcaccttccagccaaagacccagggaagggagagaagggtaggaaagagaaggctctgatccaatgcataaattgcccttagttacccaaattgggtaaattggcatggagggtatccaagccacaaggtggagaagcagccagggtctgagtaagcagacgaagcatccaggtggtggctcaccctctgcctttggctaggaaacaatgtgtgttggttgaatcccaagggacacatcttgtatttattttactgactttgcttgtatttttctaaccttgttgggtacttttttgggggtgaagaaagtctaggacaaccttttatgtttgaaattctcaaatatccctaccagaagaggcacaggctagcatggatgattccaaacaagggattgagaagtcacttccactggttttaaggtgaatggcatggaggtacccactcccccattaaatttaccttcaagcctggtgtggtggctcacgcctgtaatcccatgactcaggaggctcaggtgggaggattacatgaccccagaagtttgagacaagcctgggcaacagagcaagactctctaccctgtctcaaaaaac

SEQ ID NO: 2501 - DNA, 606 bp, Homo sapiens
tgacaatcacccttgctcctctgcatgtgagatagacagcccaggccggctattccaacagcgggatcccagcaaagccctcagttatccacctgctgcttcacagctccatctgctctgggccaccaaccgcacccgggtcactgcccaagggagcagctggacaggtcccccggcacaggcctcctcaccaccaagccctgccaaaaaacattctgccggacgatggcccctcaagtggaagggtgggggtcacagattacatcctttgaactgttcccagtgatgcccagagcctggcacccagagaggggcattccagggggcaggagagaaggctttggagctaggcagacctgggctggagcctggctctgacatgtgggacgagcctctccactccaccgttctaacccttggtcttcacatctgtaaaatgggggtgacaacatctcaatctcgagccaggcgtggtggctcacgcctataatcccagcactttgggaggcggagggaggcaaatcgcttgagtccagtagttggagaccagccctgtctctacaaaaaatacaaaaattgtctgggtgtggtggcacatgcttgtaa

SEQ ID NO: 2502 - DNA, 3684 bp, Homo sapiens
  misc_feature (720)..(720): n is a, c, g, or t
  misc_feature (837)..(837): n is a, c, g, or t
  misc_feature (1231)..(1231): n is a, c, g, or t
  misc_feature (1391)..(1391): n is a, c, g, or t
  misc_feature (3683)..(3684): n is a, c, g, or t
ggccttcgttcctcccagaaaggtctctgcctttctctagaaaaagaaagaaaagaatgaccgtttccaaggagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaactatatattcactcatatagggaatggctccaattatataaaaagtcaagggtatccatcttggagggcacatcattcttggaggaaaatgtatctgaaagagtcacataattatcagtgtagatgtcagcaaatttccatgaaaaatcatttctgtaagtgtgacagtgtcagttggctctcacatcacaatgatnaactggaagtacacagaaaagaaaactacagctgccatgactgtggagaagatatcatgaaggtatcattacttaatcaggagtcaattcaaacagaggagaagccctatccatgtnctgggtatagaaaagccttcagtaatgactccagctctgaagttcatcagcagttccacttggaagggaagccctatacatacagttcatgtggaaagggctgtaattatagttcacttcttcatattcatcaaaatattgagagagaagatgatattgagaattcacatctgaaatcctatcagagagtgcatacagaggagaaaccatgcaaatgtggtgaatatggtgagaacttcaatcactgttcccctcttaacacttatgaacttatccacacaggtgagatgtcctataggcacaacatttatgagaaagccttcagtcatagcttagaccttaatagtatttttagggtccatactagggatgaaccccatgaatatgaggaaantgagaatgtctttaatcagagttcatgtcttcaagtccatcaaaaaatccacactgaagagaaactatacacagatatagagtatggaaagagtttcatttgtagttcaaatcttgacattcagcatagggttcatatggaagagaattcatataattcncaggagtgtggtaatggcttcagtctggcctcacattttcaggaccttcagatagtccacactaaggaacaaccatataaacgctatgtgtgtagtaacagcttcagccataatttacatcttcaaggtcatccaaaaattcacattggagagaaaccacgtaaggagcatgggaatggcttcaactggagctcaaaacttaaagatcatcagagagtccacactggacagaagccatacaaatgcaatatatgcggcaaaggtttcaatcatagatcagttctgaatgttcatcagagagtccacaccggagagaaaccttataaatgcgaggaatgtgataagggattcagtcggagttcatatcttcaagcccatcagagagtccacactggagaaaaaccttataaatgtgaggaatgtgggaaggggttcagtcgaaattcataccttcaaggccatcagagagttcacactggagaaaaaccatacaagtgtgaggagtgtgggaagggcttcagtcggagttcacaccttcaaggccatcagagagtccacactggagaaaaaccattcaaatgtgaggaatgtgggaaggggttcagttggagctttaatcttcaaattcatcagagggttcacacaggagaaaaaccctataaatgtgaagaatgtggtaaaggcttcagtaaggcctcaacacttttggcccatcagagggtccacacgggagagaagccataccaatgtgatgagtgtggtaagagtttcagtcagagatcataccttcagagtcatcagagtgtccattctggagaaagaccatatatatgtgaggtatgtggaaagggcttcagtcagagagcatatcttcaaggtcatcagagagtccacactagagtgaaaccgtataaatgtgagatgtgtgggaagggctttagtcagagttcgcgccttgaagcacatcggagggttcacacaggagggaaaccatacaaatgtgaggtgtgtacaaagggtttcagtgagagttcacgccttcaagcacaccaaagggttcatgtggaagggagaccctataaatgtgaacagtgtggtaagggtttcagtgggtattcaagtcttcaagcccatcacagagtccacacaggagagaaaccatacaaatgtgaggtatgtggaaagggcttcagtcagagatcaaatcttcaggctcaccagagagtccacacaggagagaaaccatacaaatgtgatgcatgtggtaagggtttccgttggagctcaggtcttctcattcatcaaagagtccatagtagtgataaattctataaaagcgaagactatggtaaggactacccttcatcagagaatctacacagaaatgaagattctgttttgttttgaagtcctcaaatgggagctgaaattttccagtcactagagttctttcagtagaaaaagaatttttaaaaattaaaatgtaatgttgctgcccaacttcaacattcataatggccaggagaccacacaacagagacatttaatgagaggggtttcacgagggattttgttagaactttaacatcagtcattgcacaggagctaaggcttataaaatatgagtatggtcaggaatttaataaaagtacagtgatgagcatgcctaaatccatgttctctagaatgtaagcttggtgaaagaagggactttgttcattgctagtctacaaaactaggacatttcataacgcaatgtaggtgctcagtactttttgctaaataactaaaagtatgtaaaggtaaaaggtttgaaatttttaagcgcattttttaaaacttaaaatgtatttggaggagaaatcctgcaagtaatcttaataaaatcatttcaagtaaatatttgaaatgtagaacaataagcattatgatgatctgaaataacattaatttgattgtaaccctattggggttagttcccaccctttgttccatcttgagcagagatgtgctgcatttcttaacgtttggtctctatacattataccatctgctgaagtttagctttgtgtgtgtgtatatgtacccatgtgtgcactttaaatatcagtacaaactgataaacaatgtttctggttaatgttgcaaaaatggaacactgtattttacataattgattttctactcctgccctgtgaattaaggcagagttttactgtaatatttgcaagtatccaaaatggttactgatgacaaatactttttaataaatgtcaaaatcacaaaaaaaann

SEQ ID NO: 2503 - DNA, 3662 bp, Homo sapiens
  misc_feature (698)..(698): n is a, c, g, or t
  misc_feature (815)..(815): n is a, c, g, or t
  misc_feature (1209)..(1209): n is a, c, g, or t
  misc_feature (1369)..(1369): n is a, c, g, or t
  misc_feature (3661)..(3662): n is a, c, g, or t
acttccgccccaggtacgctaggccgcggccttcgttcctcccagaaaggagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaactatatattcactcatatagggaatggctccaattatataaaaagtcaagggtatccatcttggagggcacatcattcttggaggaaaatgtatctgaaagagtcacataattatcagtgtagatgtcagcaaatttccatgaaaaatcatttctgtaagtgtgacagtgtcagttggctctcacatcacaatgatnaactggaagtacacagaaaagaaaactacagctgccatgactgtggagaagatatcatgaaggtatcattacttaatcaggagtcaattcaaacagaggagaagccctatccatgtnctgggtatagaaaagccttcagtaatgactccagctctgaagttcatcagcagttccacttggaagggaagccctatacatacagttcatgtggaaagggctgtaattatagttcacttcttcatattcatcaaaatattgagagagaagatgatattgagaattcacatctgaaatcctatcagagagtgcatacagaggagaaaccatgcaaatgtggtgaatatggtgagaacttcaatcactgttcccctcttaacacttatgaacttatccacacaggtgagatgtcctataggcacaacatttatgagaaagccttcagtcatagcttagaccttaatagtatttttagggtccatactagggatgaaccccatgaatatgaggaaantgagaatgtctttaatcagagttcatgtcttcaagtccatcaaaaaatccacactgaagagaaactatacacagatatagagtatggaaagagtttcatttgtagttcaaatcttgacattcagcatagggttcatatggaagagaattcatataattcncaggagtgtggtaatggcttcagtctggcctcacattttcaggaccttcagatagtccacactaaggaacaaccatataaacgctatgtgtgtagtaacagcttcagccataatttacatcttcaaggtcatccaaaaattcacattggagagaaaccacgtaaggagcatgggaatggcttcaactggagctcaaaacttaaagatcatcagagagtccacactggacagaagccatacaaatgcaatatatgcggcaaaggtttcaatcatagatcagttctgaatgttcatcagagagtccacaccggagagaaaccttataaatgcgaggaatgtgataagggattcagtcggagttcatatcttcaagcccatcagagagtccacactggagaaaaaccttataaatgtgaggaatgtgggaaggggttcagtcgaaattcataccttcaaggccatcagagagttcacactggagaaaaaccatacaagtgtgaggagtgtgggaagggcttcagtcggagttcacaccttcaaggccatcagagagtccacactggagaaaaaccattcaaatgtgaggaatgtgggaaggggttcagttggagctttaatcttcaaattcatcagagggttcacacaggagaaaaaccctataaatgtgaagaatgtggtaaaggcttcagtaaggcctcaacacttttggcccatcagagggtccacacgggagagaagccataccaatgtgatgagtgtggtaagagtttcagtcagagatcataccttcagagtcatcagagtgtccattctggagaaagaccatatatatgtgaggtatgtggaaagggcttcagtcagagagcatatcttcaaggtcatcagagagtccacactagagtgaaaccgtataaatgtgagatgtgtgggaagggctttagtcagagttcgcgccttgaagcacatcggagggttcacacaggagggaaaccatacaaatgtgaggtgtgtacaaagggtttcagtgagagttcacgccttcaagcacaccaaagggttcatgtggaagggagaccctataaatgtgaacagtgtggtaagggtttcagtgggtattcaagtcttcaagcccatcacagagtccacacaggagagaaaccatacaaatgtgaggtatgtggaaagggcttcagtcagagatcaaatcttcaggctcaccagagagtccacacaggagagaaaccatacaaatgtgatgcatgtggtaagggtttccgttggagctcaggtcttctcattcatcaaagagtccatagtagtgataaattctataaaagcgaagactatggtaaggactacccttcatcagagaatctacacagaaatgaagattctgttttgttttgaagtcctcaaatgggagctgaaattttccagtcactagagttctttcagtagaaaaagaatttttaaaaattaaaatgtaatgttgctgcccaacttcaacattcataatggccaggagaccacacaacagagacatttaatgagaggggtttcacgagggattttgttagaactttaacatcagtcattgcacaggagctaaggcttataaaatatgagtatggtcaggaatttaataaaagtacagtgatgagcatgcctaaatccatgttctctagaatgtaagcttggtgaaagaagggactttgttcattgctagtctacaaaactaggacatttcataacgcaatgtaggtgctcagtactttttgctaaataactaaaagtatgtaaaggtaaaaggtttgaaatttttaagcgcattttttaaaacttaaaatgtatttggaggagaaatcctgcaagtaatcttaataaaatcatttcaagtaaatatttgaaatgtagaacaataagcattatgatgatctgaaataacattaatttgattgtaaccctattggggttagttcccaccctttgttccatcttgagcagagatgtgctgcatttcttaacgtttggtctctatacattataccatctgctgaagtttagctttgtgtgtgtgtatatgtacccatgtgtgcactttaaatatcagtacaaactgataaacaatgtttctggttaatgttgcaaaaatggaacactgtattttacataattgattttctactcctgccctgtgaattaaggcagagttttactgtaatatttgcaagtatccaaaatggttactgatgacaaatactttttaataaatgtcaaaatcacaaaaaaaann

SEQ ID NO: 2504 - DNA, 3121 bp, Homo sapiens
  misc_feature (698)..(698): n is a, c, g, or t
  misc_feature (815)..(815): n is a, c, g, or t
  misc_feature (1209)..(1209): n is a, c, g, or t
  misc_feature (1369)..(1369): n is a, c, g, or t
  misc_feature (3071)..(3071): n is a, c, g, or t
acttccgccccaggtacgctaggccgcggccttcgttcctcccagaaaggagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaactatatattcactcatatagggaatggctccaattatataaaaagtcaagggtatccatcttggagggcacatcattcttggaggaaaatgtatctgaaagagtcacataattatcagtgtagatgtcagcaaatttccatgaaaaatcatttctgtaagtgtgacagtgtcagttggctctcacatcacaatgatnaactggaagtacacagaaaagaaaactacagctgccatgactgtggagaagatatcatgaaggtatcattacttaatcaggagtcaattcaaacagaggagaagccctatccatgtnctgggtatagaaaagccttcagtaatgactccagctctgaagttcatcagcagttccacttggaagggaagccctatacatacagttcatgtggaaagggctgtaattatagttcacttcttcatattcatcaaaatattgagagagaagatgatattgagaattcacatctgaaatcctatcagagagtgcatacagaggagaaaccatgcaaatgtggtgaatatggtgagaacttcaatcactgttcccctcttaacacttatgaacttatccacacaggtgagatgtcctataggcacaacatttatgagaaagccttcagtcatagcttagaccttaatagtatttttagggtccatactagggatgaaccccatgaatatgaggaaantgagaatgtctttaatcagagttcatgtcttcaagtccatcaaaaaatccacactgaagagaaactatacacagatatagagtatggaaagagtttcatttgtagttcaaatcttgacattcagcatagggttcatatggaagagaattcatataattcncaggagtgtggtaatggcttcagtctggcctcacattttcaggaccttcagatagtccacactaaggaacaaccatataaacgctatgtgtgtagtaacagcttcagccataatttacatcttcaaggtcatccaaaaattcacattggagagaaaccacgtaaggagcatgggaatggcttcaactggagctcaaaacttaaagatcatcagagagtccacactggacagaagccatacaaatgcaatatatgcggcaaaggtttcaatcatagatcagttctgaatgttcatcagagagtccacaccggagagaaaccttataaatgcgaggaatgtgataagggattcagtcggagttcatatcttcaagcccatcagagagtccacactggagaaaaaccttataaatgtgaggaatgtgggaaggggttcagtcgaaattcataccttcaaggccatcagagagttcacactggagaaaaaccatacaagtgtgaggagtgtgggaagggcttcagtcggagttcacaccttcaaggccatcagagagtccacactggagaaaaaccattcaaatgtgaggaatgtgggaaggggttcagttggagctttaatcttcaaattcatcagagggttcacacaggagaaaaaccctataaatgtgaagaatgtggtaaaggcttcagtaaggcctcaacacttttggcccatcagagggtccacacgggagagaagccataccaatgtgatgagtgtggtaagagtttcagtcagagatcataccttcagagtcatcagagtgtccattctggagaaagaccatatatatgtgaggtatgtggaaagggcttcagtcagagagcatatcttcaaggtcatcagagagtccacactagagtgaaaccgtataaatgtgagatgtgtgggaagggctttagtcagagttcgcgccttgaagcacatcggagggttcacacaggagggaaaccatacaaatgtgaggtgtgtacaaagggtttcagtgagagttcacgccttcaagcacaccaaagggttcatgtggaagggagaccctataaatgtgaacagtgtggtaagggtttcagtgggtattcaagtcttcaagcccatcacagagtccacacaggagagaaaccatacaaatgtgaggtatgtggaaagggcttcagtcagagatcaaatcttcaggctcaccagagagtccacacaggagagaaaccatacaaatgtgatgcatgtggtaagggtttccgttggagctcaggtcttctcattcatcaaagagtccatagtagtgataaattctataaaagcgaagactatggtaaggactacccttcatcagagaatctacacagaaatgaagattctgttttgttttgaagtcctcaaatgggagctgaaattttccagtcactagagttctttcagtagaaaaagaatttttaaaaattaaaatgtaatgttgctgcccaacttcaacattcataatggccaggagaccacacaacagagacatttaatgagaggggtttcacgagggattttgttagaactttaacatcagtcattgcaggactaggctatctgtgaagaggacttgtatgtagctcaactagcattatacgatgagtgtagactttgtatactaagttgaaggtaaggtgaattagccatntaactaatgattgaggatctgagactataacatcagaatgatggactagt

SEQ ID NO: 2505 - DNA, 483 bp, Homo sapiens
ccgctgtccacggggagggagccccaaagaagccgcaaggttgaaggagaggtgaggagaggtcagtcatcatcagaagaaatacttttctggctccaaaggacgacaactttgacagatgccctctttcacaccaaccaataagtggtgtttgtttgttttcaggaaataataaccacaacaacgtgccaagcactttgcaagtataatattaattactttccgcaacacccttcctagctaagtttgtaatttctctcgctttagcaatggataaactcagggaagttaagcatgttcggccctccagatttgcggattcatcatccaaattcagctaaccacggatgagaaacatttgaggaaaaaaagaatgcttgcatctgtacggaacatgtacggacttttttttccttgtcatcattccctaaataatccaatgtaacaactacttatgtaacaattacatagtacttgatatta

SEQ ID NO: 2506 - DNA, 1498 bp, Homo sapiens
tttttttttttttttttttgggatggagttttgcgcttcttccccaggctggagtgcagtggcgcaatctcggctcactaaaacctctgcctcccaggttcaagcaattctcctgcctcagcctcccaagtagctgaaattacaggtgcccgccactatatctggctaattttttttatatttttgatagagatggggtttcgtcatgttggccaggctggtcttgaaatcctgacctcaggtgatctacccacctcggcctcccaaagtgctgggattacaagtatgagccaccttgcctggcccgttttttcttacttttagtaaaaataacctcacgtaaactgtcataggtgtctgtgggcttatttttgatgttctcctttgttggaaattcttgtgaaataccttccaggtcttagtctttgtgaggatcaggttctgctttcaattggatgttttaagaattagttttaaaataatttgtttttcttattattagcaccctatgtttagttgctgtacttatttggatagtgtggtaagcacagtggcttaggcatgagaaatataactagagatctcataattttatgtgtttataaagtgttttatttaaaaattaaataattgcaaatgagtggataaagaaactgatatatatatatctgattatatatatatatatctgattatgtatatatatctgattatatatatatgatggaatactacccggctataagaatgaatgaattaatggcatttgcagtaacctggatgggattggagactattattctaagtgaagtaactcaggaatggaaaaccaaacatcgttatgttctcgctcataagtaggagctaagctataaggatgcaaaggcataagaatgacacagtggcttttggggactcagagggaaagggtaggaaggagatgagggataaaagactacaaattgggttcatgtgtactgcttgggagatgggtgcaacaaaatctcagaaattaccactaaagaatttactcgtgtaaccaaataccacgtattccccagaagcctgtggaaataaaaaattaaaaaaattgcaaatgtaaataagacagtaacaaagatggcaaagaacaaagatgaaaaagtatgctgtattacctgaaagtgcttttatggatatcttagcttatccttcgtccatttaaatattgttagttttagccgggaacatgcctgtagtcccagcaccttgggaggctgaggcgggcagaccacttgagaccaggagtttgagaccagccaggccaacatggtgaaacccgtctctactgaaaatataaaaattggccgggcgttggggcgcatgcctgtggtcccagctatttaggaggctgaggcgggacaatcgcttgaacctgggaggcggaggttgcagtgagacgagattgtgccactgaactccagcatgggtgacagagtgggaccctgtctccaaaaaa

SEQ ID NO: 2507 - DNA, 324 bp, Homo sapiens
tcatgaataagtgttgttaaaatagaataggttttccagttttcttaaacagtaataatgcttttgaatgcattaaatatttttaaaaacagttttattgtggatagttaggttacacaccatgacaaaacctacctaacataaaatatatctggtgatatttagaacttatagacatatgagggctaaagaaagggtctcaattacattaggatcatattagactagagacctagcattgcctaaattctgcttttctgtctccatagttgctacaaggtcctaagggagccattcacagatcaatggactgattaaaaaaaa

SEQ ID NO: 2508 - DNA, 620 bp, Homo sapiens
ttttttttcttgagatggagtttcactcatcgcccaggctggaggataatgccataatctcagctcactgccctccagcctggcagaagagcgagactccatggacagcagcctcttgctcatgtgaccgtcccgtgtgtgctcctggagaggaggctccggtgtctcttcccatgagggcactcatctcatcgtgagggtcccccaggatcttctctaaacctgctcccctcccaaaggccccacctccaacactgtcttgctgggggtgaggactttaacatgtgaactggaggtgagggacaagtatccagtccacagcaaccccaactctgggacccagtttctctactggcacttgctgagtaaccacccacccagacgcctggtggctcacagctgcagggacacggtgcttctgtggccgcaggcgtgaggacccgggtcctggcctccctggggcctgttcctcggctgtgcccggttactcagggctgctctggtcctgcctccccaaggagagcccttgtgaggtcacaggtgcagaaggaagcccgtccgatgcagacggatgttccagccaggcagagaggagaaaatcagtacctaaagcatctgac

SEQ ID NO: 2509 - DNA, 1026 bp, Homo sapiens
acattttcagatatgcaaactcttacttttaaaaattcattttcaaaatacatgttttcaggagcctactaaaggaggagctccaaatcaagggagcaaaccaagaaagaggaagaaggggctggccactgtgctgtaatcccagcaacccgcccaaaggcaatttttttcacccaaatttttcactactacctaatcatggtttcttctgctaatagtctcctccccgtgtttctgttctccagccccagactgcactcgcagtcagtgcactgcgtcttaggtgttgcttctgccaacagctgtcttagacgaggtggctctgccaacacctgtcttagacgaggtggctctgccggcacctgtcttagacgaggttgctgtgtcaaaattccacagaccgactggcttcacagcagacatttctttctcccagctctgcaggctgggagtccagcctccaggtgccacagacccagttcctgttgagggaccacccccagcttacggacagcagcctcttgctcatgtgaccgtcccgtgtgtgctcctggagaggaggctccggtgtctcttcccatgagggcactcatctcatcgtgagggtcccccaggatcttctctaaacctgctcccctcccaaaggccccacctccaacactgtcttgctgggggtgaggactttaacatgtgaactggaggtgagggacaagtatccagtccacagcaaccccaactctgggacccagtttctctactggcacttgctgagtaaccacccacccagacgcctggtggctcacagctgcagggacacggtgcttctgtggccgcaggcgtgaggacccgggtcctggcctccctggggcctgttcctcggctgtgcccggttactcagggctgctctggtcctgcctccccaaggagagcccttgtgaggtcacaggtgcagaaggaagcccgtccgatgcagacggatgttccagccaggcagagaggagaaaatcagtacctaaagcatctgac

SEQ ID NO: 2510 - DNA, 367 bp, Homo sapiens
tacatctttgcaaacttaaatggttttcatggcttttcagcaaaaacacaataaacaaccttacgtagcttccataaagaaattaaatgggccaggcacggtggctcatgcctgaaatctcagtactttgggaggctgaggtgggaggattgcttgagcttagagcccagtctgggcaatataaggagaccttgtttctactaaaaacaaaacaaaaacaaaaactaactgggtgtgttggtgtgcatctatagtctcagctacttgggaggctgaggcgggaggatcgcttgagcccaggaggttgaggctgcagatcgcgccactgcactccagcctgggcaagaaaatgaggccctgtctttca

SEQ ID NO: 2511 - DNA, 261 bp, Homo sapiens
gcttctgagtctgagtcactgaggacagccttattcagaaacacaaaatcttaagagtttgaagaagatctcaaatttcccttccccttttaatgcaatctggacatattcaaagaaatatatgagccctcagatgtgaaggatatcctttccccagcatctctgccagtgggcacacagtctctttttaaatattttgaagatggtgaagggacattacttctcagggcaaccagtgctaatgaagttttgtgttactgt

SEQ ID NO: 2512 - DNA, 855 bp, Homo sapiens
gtgctggttgacttgacctgctgcgtttctggctgggtcccgttctgtttttcccagtgtttgttccagtgtagaggctgggtgtggttcttgatacaggcccttcatgtctacatctgccctaactgtaggtcaccaaatcttacacagccttttacatgacaaaaggtgttgattcagatgaaccgattctgaagaccaggctgctgggcactgggctcccagatggagggtggatcagaaccttctgaggatcctgaaacatcccacttcctactgacatcactaatgtacacgtctaggaagcctttcttgtgtggaccaatcctatgaatccctacatctggtggctccggtggttagtgtgtgaaccaggggactatatgtctgcaaacagtggcttgaatgttaaagatttgctttgggtagatttaacctcattatttttttccccccttggttagtaatacccagagtgtttcatctattacctcatttgtcttctagaagtctgggaattaggatttgcaggcgcccactcttttattgatatggaaggagaaagcatggggcttacctaaaggtcagagagaaagaatagattgtaacttttattctcggcctggattacatatttcttgtgtgtcatatttagcttcacaattttagctgtcttaaaagaaaaagaaaaaaatctattagtgttcaataattgaagattttgtttgttgttaaaaccaggaaattagatcatttccctggtctaattgatctgaaataaattgcagactgagggagagatgaagagggagacaaactaatgcgtgtaacgtttttaacactcagtgatctggg

SEQ ID NO: 2513 - DNA, 229 bp, Homo sapiens
gtagccctgaggctacgttgctcagtgtcacacacagccaagactcatgtcacacacagccaagactcagacctgggcctttggacttcggagtctttaacatttgtgattacccttcttctatactgtctctttccgtgtctgtaagtgctgttcagtttccacatgtcaactcattccatccactcagcaacctcatgtggtataggtcctgccatatggggtagcc

SEQ ID NO: 2514 - DNA, 446 bp, Homo sapiens
ttgagaaagcctgaagaccctgagctagagacacactgtttagaaagatgagccctggaaacactagtgagggagaaaagtaagcagaaatgagcgccggagactccaccaagggagtctgaaaagtcagggcactgtgggtgaacttgaacctgaatgtagaatggctcttacggtatctataatttgcaaacttcttatatactatttacataatagttctccacttagagatctttaacacaccttcttgttttttggaatgtgacaagttttatagctagtatggacaggagagaggataactttaaaatgtggtgaatagggctgggcgctgatggcctatgcctgtaatggcagcattttgggaggctgaggcaggaggatcgcttgagcccaggaatttgaggacagcctgaacaacacagcaagaccttgtctcttta

SEQ ID NO: 2515 - DNA, 957 bp, Homo sapiens
aaaccagccagtgaagttaactaaactcctaacgtgccagagtgctttctttagaacaaatatacctgtttacaagagagtagtgatctcgtcaagtgaaccttgttgttatattttaaatctttagtatctgctggacaaaaagaggtatcagctgatgtggtttacacctcattgcttcctagtgaacgttacctggcacagacttttgtttctgagataggaaggaagaagctagagatcaccagtccctgaggcactgttttcaaatatgctgttaaccactggtcaggagtctgcagtgcagccacgctattggctgcttcttgacaatgtcatgtaaattatcagtgagctcttctcagagtcaagccgtccaagagctttgcttcgtccctggtgcctaatagcagactataaagaagtcttatccctgagagagatttaccagcatggggaagaaagcttgcatttagatgccatgttccagttggaaaagtcctttcagatgcatcagtgcctggctgtaacttcacagtgactctgggcagagcccagggttcctatctctgttgtccaaatgggcagactgaggctggcccaaggtcatccacagctgctgatgagacccgaggcccttgatgtggacctgctggccacagggcagtgtgcttgtcacgtggtggaatttcagattgcgttgcatggaacagagctcccacaagctggccgagggatgctggggagaacgcactcagggcaccagggctcctacgccactcagccagagctgctcctctcttacctgttttataggttaaaagcttttgacagaaactatcataaaggtttaaaaactgctgaccctggccaggcgtggtggctaatgcatgtaaccccagcactttgagaggccgaggcaggtggatcacctgaggtcaggagtttgagagcagc

SEQ ID NO: 2516 - DNA, 227 bp, Homo sapiens
gagaggaaagaatgtgctatcaggaaatggggcttagacgaaagagaaggtatccttaggccctgccaccttggatactgctgagtaaggtctaggaactggctcatccagcccttcccttagagggtttccacctcccctctcccacactggctgtcctctccttcccttcatctaccacaccctctgctgcctgtgcccccatccctctgcctggaactatggcc

SEQ ID NO: 2517 - DNA, 793 bp, Homo sapiens
aattttctgagtttttttttaaaaaaactaattatacaaacttgaaagggttcaccttgccctagcaaaactaggattgggacacctttttttccccctgaggatcactgacaaaaaacactgcaccagtaaggaagcaactaaattttgttttgttctttgaaaaaggctaacctgagctaggtaaaggttatatcattcacttttgaaataaaccatcgagaacacaaaatgacaagtgagttaggttgggctgatgggatagaaggtgggaggggaatgctatacagctgggaacagcagactttctctgaagggccagatggtaactacattagggtttgcgggtctgatggtcgccatcataactgcatactcaactctgccgttgtagggtaagagcagcactcgatgacacagaaatgaatgcacatgactgtgttccagtaaaattttattttaattaaaatcaattcatgtttgaaaaaggatttaaagtagcttctaataaaggacatgtgtaatgaaacttaaaatatgatattttctttaaaaatctttatccttatgtagacttctaaaactatgttttgcatttagacagtcaaggaaaatacaagttgttatacaattctcattgactaattgaagtttactaggagaggaaaactttttcttgataccggcaatcttttacttataatggcttgagttaaaatgctccaacttttctaatttttgcttttgaaaataaaacacctatagtgacaataaaaacacacatttaaagcca

SEQ ID NO: 2518 - DNA, 490 bp, Homo sapiens
gcaatggtcctgtcggttttggtgtttggattgtttggctttgttttccttttttattcttcctgtttttaatgctgtgtaagatctcctgctatgaatgttccagttacccctattgtactgtatatacgtgtgctgcatgtgtaaattctgtttcaggttttggagttttcatcttaagtacagctggtcctgttgtgaactcatctttcctgtatgctcctctgtgtctgatttccaattgccaaaatgtttgaccaaatgtgttttgacaaatatcccgagacagccatgcgtatccttgtgaaagggcatgctccatgtgggatggctcgtgtacagcataaatctatcaaacttggaattgtgtatacatttatatgccagataactaacattcatgtaacagctgcaaagatatttagtgtatatcagattaataaaagagcatttttttttttgctccattatattcaaatacagattgctg

SEQ ID NO: 2519 - DNA, 525 bp, Homo sapiens
gcttatgagaggttggagaagcaaaagctagggagaatggagaaagtgaagcatttttgaaaaagctgctgatgtgctatacgtcccggtctcttctcaagaaagaagcctcaaatccagtggaaaaagtttaacaaaactatttggaagatgtaggggtggcaaaactacttggaataacttgatatctttctcattcagagaatccagcctcctacctgccatatctaagtgataagagattcacaagctagttgctgataaaagtgcaaaagaaggccaggggcagtgggtaatgcctgtaatcccagcagtttgggaggccaaggagggcggatcacctgaggtcaggagttcaagaccagcctggccaacatggcgaaactccgtctctactaaaaatacaaaaattagctgggcatggtgttgggcacctataatcccagttgcttgggaggctgaggcagggagaatcgcttgaactcgggaggcggaggtttcagtgagctgagattgagccattgc

SEQ ID NO: 2520 - DNA, 591 bp, Homo sapiens
ggattcctttcctatgatgccaatcaaacatgcaatccagtggctttatccatatagtattttactaggtcatgaagggaagatggctgtggaaggtgttttaaagcgctttgaacttcaagattcaggaagctctctacttcctaaagagattgtaaaagtagagaagatgatggaaaaccatgtgtcccaagcttctgtgaccatccggattgcagataaagaggtgaccattaaggtgccagccgggaccaggctattaagtcaaccttgtgcgtcagaccgtttcatacagactttgagccataagcagctacaggctgaaatgatgcagtctcacatggttaaagatatatgtttaattggaggaaagggttgtggaaaaacagtgatcgctaagaactttgccgataccttaggatacaacatagaacctattatgctctatcaggtacagtgttcatttttagctgcacttggactataagcatatatgcttaggccatcagcagaatttatggatatcttcttgttatgacctgtgtttttttatataggtaaagaaccaaaatagtaataaaattattcaaa

SEQ ID NO: 2521 - DNA, 6123 bp, Homo sapiens
ggattcctttcctatgatgccaatcaaacatgcaatccagtggctttatccatatagtattttactaggtcatgaagggaagatggctgtggaaggtgttttaaagcgctttgaacttcaagattcaggaagctctctacttcctaaagagattgtaaaagtagagaagatgatggaaaaccatgtgtcccaagcttctgtgaccatccggattgcagataaagaggtgaccattaaggtgccagccgggaccaggctattaagtcaaccttgtgcgtcagaccgtttcatacagactttgagccataagcagctacaggctgaaatgatgcagtctcacatggttaaagatatatgtttaattggaggaaagggttgtggaaaaacagtgatcgctaagaactttgccgataccttaggatacaacatagaacctattatgctctatcaggatatgacagcgcgtgatctgctacagcagagatacacccttccaaatggagacactgcctggcggtcctcaccccttgtgaatgctgctctggaaggcaagctggtcctgctggatggcattcaccgggtgaatgcgggcacgcttgctgtattgcaaaggttaatccatgatcgagagctaagcctctatgatggttctaggctgctgagagaagacaggtatatgcgtttaaaggaggagctgcaactgtctgatgaacagctacagaagagatccatttttcctatccatccctccttcagaatcattgccttggcagaaccccctgttattggaagcacagcacaccagtggctgggaccagaattcttaaccatgttctttttccattacatgaaaccacttgtgaaaagtgaagaaatccaagtgattaaggaaaaggtcccaaatgtacctcaggaagctctggataagttattatcatttacacacaaactcagagaaacacaggatccaacggcacaatcattagcggcatcactttctaccagacaactgttgcgaatttctcgtcggctgtcacagtatcctaatgaaaatcttcacagtgctgttactaaagcctgcctttccaggtttttacccagtcttgctaggtcagcattagaaaaaatctggcagatgctacaatagaaataaatactgatgacaatttggagccagaactgaaggattacaaatgtgaagtaacatctggaactctgaggattggtgctgttagtgcaccgatctataatgcacatgagaaaatgaaagtgcctgatgttcttttctatgacaacattcagcatgtgatagtgatggaagatatgctgaaagactttctccttggagaacacttattattggttggcaaccagggtgtaggaaaaaacaagattgttgacagattccttcacctgctcaacagaccccgagaatatattcagctacacagggataccacagtacaaactcttacgcttcagccttcggttaaagacggacttattgtatatgaagactcacctttggttaaagcagtaaagttgggtcatattctggtagtagatgaggctgacaaagctccaacaaatgtcacgtgtattttaaaaactctagtagaaaatggagaaatgattctagcagatggaagacgcattgttgcaaattctgctaatgtgaatggaagagaaaatgttgtagtgattcatcctgattttaggatgattgttctggcaaatagacctggatttcctttcctaggcaatgatttcttcggtaccttaggtgatatttttagctgccatgcagttgataaccccaaaccccactcggagctcgagatgctcagacagtatggaccaaatgtgcctgagcccatccttcagaagcttgtggctgcctttggagagctgaggagtttggctgaccaagggattattaactatccttattctaccagagaagttgtcaacatagtcaaacatttacagaaatttccgactgaaggtctctccagtgtagttcgaaatgtgtttgactttgattcctacaacaatgacatgagggagatattgattaacactttacacaaatacgggatacctatcggagcaaagcctaccagtgtgcagctggcaaaggagttgactctgccagaacaaacgttcatgggctactggacaattggtcaggcaagaagtgggatgcaaaaactcttgtgtccagtggaaactcatcatatagacataaagggtccagcacttataaatatacaggagtatccaatagaaagacatgaagaaagatccctaaactttactgaagaatgtgcctcatggagaataccattggatgaaattaatataatctgtgacattgctacatcacatgaaaatgagcaaaatactctctatgtagttacatgcaatcccgcttccctgtactttatgaatatgactgggaaaagtggcttctttgtggacttttttgatatcttcccaagaacagccaatggcgtttggcacccttttgtgacagtggcaccgctgggaagtcctctcaaaggtcaagtggttctccatgagcagcagagtaatgttatcctgttgttagatactactggccgggcccttcatcgtctcatcctcccttccgagaagtttacatctaagaaacctttctggtggaacaaagaagaagctgaaacttataaaatgtgtaaagaattttcacacaaaaactggctggtgttctacaaagaaaaagggaacagcctgactgtgctggatgttctagaagggcgaactcacaccatctcacttcccatcaacctcaagacagttttccttgtagcagaggacaaatggcttctggtggagagcaaaacaaatcagaaatatcttttaactaagcctgcacacatcgaatctgagggtagtggggtttgccagttgtatgtgctgaaagaggagccgcccagcacagggtttggagttacacaagaaacagagttcagcatacctcataaaatttccagtgatcaactatcatctgaacatctaagttcagctgtggaacaaaagattgcctctcccaacagaattctctcagatgagaaaaattatgctacaatagttgttggttttccagatctcatgtcacccagtgaagtttattcttggaagagaccatcatctttgcataaacgaagggcactgatacatcattctatagaggaaagaagaaaagggggactccaaaacaaagcaattgtgtgactcttttagatacgaatcaggtagtgaggattttacccccaggagaagtccctctaaaagatatctacccaaaagatgttactcctccacaaacatctggttatatagaagtcactgatcttcaatcaaagaaactccgatatatccctattcccagatcagaatctctctcgccgtataccacatggctgtcgaccatttcagacacagatgcactgctggctgagtgggacaaaagcggtgttgttactgttgatatgggaggtcacatcaggctttgggaaactggacttgaacgtctgcagcgatcactcatggaatggagaaacatgattggacaagatgacagaaatatgcagataacaatcaacagagacagtggtgaagatgtaagctcccccaaacacgggaaggaggacccagacaacatgcctcacgtgggcggcaacacttgggctggcggaacagggggaagagacacggcaggcctgggtggcaaaggaggcccttaccggctggatgcaggccatacggtgtaccaggtctctcaggctgagaaagatgcagttcccgaagaggtcaagagagctgctagagagatgggccagagagcattccagcagaggctaaaggagatccaaatgagtgaatacgatgctgcaacctatgaaaggttttcaggtgctgttcggcgacaggtgcactccctccgaatcatcctggataatttacaggctaaaggtaaagaaagacaatggctaagacatcaagctactggagaattagatgatgccaagatcattgatgggctgactggagaaaaagccatctacaaacgtcggggtgagctggagccacaacttggcagcccacaacagaaacccaagcgtctgcgcctggtggtagatgtgtctggtagcatgtaccgtttcaacaggatggatggccggcttgagcgcacaatggaggctgtgtgtatggtcatggaagccttcgagaactatgaggagaagttccagtatgacatcgttggacactctggagatggctacaacattggtctggttccaatgaacaaaatccccaaggacaataagcaaagactagaaattctgaagacaatgcatgcccactctcagttctgcatgagtggggaccacacgttagaagggacagaacatgccatcaaggaaattgtcaaagaagaagctgatgagtactttgtcatagtcttgagtgatgcaaatctgtcacgatatggaatacatcctgctaagtttgctcaaatcctcacaagagaccctcaagtaaatgcttttgccatttttattggctctttaggtgatcaagcaaccaggcttcagagaactttaccagctggtcggtctttcgttgccatggataccaaggatatccctcagattttacaacagatcttcacctccaccatgttgtcgagtgtctaagaagtgcccttcatcaccctgatgacaccaggatttgaaataagacaggaataaagagtattctgaaaaaaagaagatatggatgaagtgaacccatgcagtgactggatgattccggcattcctgggtcttcctacacttgctccgtaatgagaattcagagaagcagccagaaggagacttaaacatggaaagatactccactgatgagtttagaagtgattagggcaagctagttgacctgcactttatcaaaggttggggttaaaggaaggtggttttgagaactatgtgtttggtctatttccaaaaacctgagggggagaaaatactttgcttttgccttaacacatcatctggtcacgttagaaaagtgaccccatcaaactgagcctttgatgtcacattctgacacaagatgcaagtctgtgcaaaacccaccaaaatgctcctatccaacaattatttttattttctccctgctctgtattgaccagaaaacaatgattttataatatttaacccaccaaaaagtccctccaacagcaatatcttatgaaaggctggctgttctcaataatttcattttcttggccaaagccaaaaggaatcaaaaaatccttggagtgcttgcctttccacgtgacttttaaaaggctcttaaagagcaaatgtcctcttctccttgctgctagagtgggaggagaaagatgtcttgccttaaaagtttactgtttcttctgttcttctagcatctctcaaaaaattcacagtactccattttggggtccaaactgtaatgctcaaaataataaatgcttacacgaaaattatttattgagaatattcatataaaaattacctaaagcaaagtaaaaaaagtaaaatcaaggtggtatatttgaagtgaatggtgattggaaatttttagctgtaacaaaaagaaagaaaacaactttttttaaagcctcattctcttttctttcaaaatgtaccttattcccacacactcttgggctgacctttattttatcaataagctcaatattactttgtttaaaataagatgcttcagcaaaagtcattctctctttaaccatataatttaaaaactcctcttcacgattgatagcaaaatcagaaacgttagggcaccagtgagttgaaaaaactggtcttaagttggaaaaactattattaataatattatcctatccatccatatctattgaaattgtacaggtccataatttcattttaattaattataggaaagaagaaaagataatacccatttgttctatcacccctctccctatcattaactatcaaataaataaataaaagcaatctgatttccaacgtggtactaaaaaaaaag

SEQ ID NO: 2522 - DNA, 5177 bp, Homo sapiens
tagggaacggagcggggacggcggagtgagggagagtatgaggggatactttctaccagacaactgttgcgaatttctcgtcggctgtcacagtatcctaatgaaaatcttcacagtgctgttactaaagcctgcctttccaggtttttacccagtcttgctaggtcagcattagaaaaaatctggcagatgctacaatagaaataaatactgatgacaatttggagccagaactgaaggattacaaatgtgaagtaacatctggaactctgaggattggtgctgttagtgcaccgatctataatgcacatgagaaaatgaaagtgcctgatgttcttttctatgacaacattcagcatgtgatagtgatggaagatatgctgaaagactttctccttggagaacacttattattggttggcaaccagggtgtaggaaaaaacaagattgttgacagattccttcacctgctcaacagaccccgagaatatattcagctacacagggataccacagtacaaactcttacgcttcagccttcggttaaagacggacttattgtatatgaagactcacctttggttaaagcagtaaagttgggtcatattctggtagtagatgaggctgacaaagctccaacaaatgtcacgtgtattttaaaaactctagtagaaaatggagaaatgattctagcagatggaagacgcattgttgcaaattctgctaatgtgaatggaagagaaaatgttgtagtgattcatcctgattttaggatgattgttctggcaaatagacctggatttcctttcctaggcaatgatttcttcggtaccttaggtgatatttttagctgccatgcagttgataaccccaaaccccactcggagctcgagatgctcagacagtatggaccaaatgtgcctgagcccatccttcagaagcttgtggctgcctttggagagctgaggagtttggctgaccaagggattattaactatccttattctaccagagaagttgtcaacatagtcaaacatttacagaaatttccgactgaaggtctctccagtgtagttcgaaatgtgtttgactttgattcctacaacaatgacatgagggagatattgattaacactttacacaaatacgggatacctatcggagcaaagcctaccagtgtgcagctggcaaaggagttgactctgccagaacaaacgttcatgggctactggacaattggtcaggcaagaagtgggatgcaaaaactcttgtgtccagtggaaactcatcatatagacataaagggtccagcacttataaatatacaggagtatccaatagaaagacatgaagaaagatccctaaactttactgaagaatgtgcctcatggagaataccattggatgaaattaatataatctgtgacattgctacatcacatgaaaatgagcaaaatactctctatgtagttacatgcaatcccgcttccctgtactttatgaatatgactgggaaaagtggcttctttgtggacttttttgatatcttcccaagaacagccaatggcgtttggcacccttttgtgacagtggcaccgctgggaagtcctctcaaaggtcaagtggttctccatgagcagcagagtaatgttatcctgttgttagatactactggccgggcccttcatcgtctcatcctcccttccgagaagtttacatctaagaaacctttctggtggaacaaagaagaagctgaaacttataaaatgtgtaaagaattttcacacaaaaactggctggtgttctacaaagaaaaagggaacagcctgactgtgctggatgttctagaagggcgaactcacaccatctcacttcccatcaacctcaagacagttttccttgtagcagaggacaaatggcttctggtggagagcaaaacaaatcagaaatatcttttaactaagcctgcacacatcgaatctgagggtagtggggtttgccagttgtatgtgctgaaagaggagccgcccagcacagggtttggagttacacaagaaacagagttcagcatacctcataaaatttccagtgatcaactatcatctgaacatctaagttcagctgtggaacaaaagattgcctctcccaacagaattctctcagatgagaaaaattatgctacaatagttgttggttttccagatctcatgtcacccagtgaagtttattcttggaagagaccatcatctttgcataaacgaagggcactgatacatcattctatagaggaaagaagaaaagggggactccaaaacaaagcaattgtgtgactcttttagatacgaatcaggtagtgaggattttacccccaggagaagtccctctaaaagatatctacccaaaagatgttactcctccacaaacatctggttatatagaagtcactgatcttcaatcaaagaaactccgatatatccctattcccagatcagaatctctctcgccgtataccacatggctgtcgaccatttcagacacagatgcactgctggctgagtgggacaaaagcggtgttgttactgttgatatgggaggtcacatcaggctttgggaaactggacttgaacgtctgcagcgatcactcatggaatggagaaacatgattggacaagatgacagaaatatgcagataacaatcaacagagacagtggtgaagatgtaagctcccccaaacacgggaaggaggacccagacaacatgcctcacgtgggcggcaacacttgggctggcggaacagggggaagagacacggcaggcctgggtggcaaaggaggcccttaccggctggatgcaggccatacggtgtaccaggtctctcaggctgagaaagatgcagttcccgaagaggtcaagagagctgctagagagatgggccagagagcattccagcagaggctaaaggagatccaaatgagtgaatacgatgctgcaacctatgaaaggttttcaggtgctgttcggcgacaggtgcactccctccgaatcatcctggataatttacaggctaaaggtaaagaaagacaatggctaagacatcaagctactggagaattagatgatgccaagatcattgatgggctgactggagaaaaagccatctacaaacgtcggggtgagctggagccacaacttggcagcccacaacagaaacccaagcgtctgcgcctggtggtagatgtgtctggtagcatgtaccgtttcaacaggatggatggccggcttgagcgcacaatggaggctgtgtgtatggtcatggaagccttcgagaactatgaggagaagttccagtatgacatcgttggacactctggagatggctacaacattggtctggttccaatgaacaaaatccccaaggacaataagcaaagactagaaattctgaagacaatgcatgcccactctcagttctgcatgagtggggaccacacgttagaagggacagaacatgccatcaaggaaattgtcaaagaagaagctgatgagtactttgtcatagtcttgagtgatgcaaatctgtcacgatatggaatacatcctgctaagtttgctcaaatcctcacaagagaccctcaagtaaatgcttttgccatttttattggctctttaggtgatcaagcaaccaggcttcagagaactttaccagctggtcggtctttcgttgccatggataccaaggatatccctcagattttacaacagatcttcacctccaccatgttgtcgagtgtctaagaagtgcccttcatcaccctgatgacaccaggatttgaaataagacaggaataaagagtattctgaaaaaaagaagatatggatgaagtgaacccatgcagtgactggatgattccggcattcctgggtcttcctacacttgctccgtaatgagaattcagagaagcagccagaaggagacttaaacatggaaagatactccactgatgagtttagaagtgattagggcaagctagttgacctgcactttatcaaaggttggggttaaaggaaggtggttttgagaactatgtgtttggtctatttccaaaaacctgagggggagaaaatactttgcttttgccttaacacatcatctggtcacgttagaaaagtgaccccatcaaactgagcctttgatgtcacattctgacacaagatgcaagtctgtgcaaaacccaccaaaatgctcctatccaacaattatttttattttctccctgctctgtattgaccagaaaacaatgattttataatatttaacccaccaaaaagtccctccaacagcaatatcttatgaaaggctggctgttctcaataatttcattttcttggccaaagccaaaaggaatcaaaaaatccttggagtgcttgcctttccacgtgacttttaaaaggctcttaaagagcaaatgtcctcttctccttgctgctagagtgggaggagaaagatgtcttgccttaaaagtttactgtttcttctgttcttctagcatctctcaaaaaattcacagtactccattttggggtccaaactgtaatgctcaaaataataaatgcttacacgaaaattatttattgagaatattcatataaaaattacctaaagcaaagtaaaaaaagtaaaatcaaggtggtatatttgaagtgaatggtgattggaaatttttagctgtaacaaaaagaaagaaaacaactttttttaaagcctcattctcttttctttcaaaatgtaccttattcccacacactcttgggctgacctttattttatcaataagctcaatattactttgtttaaaataagatgcttcagcaaaagtcattctctctttaaccatataatttaaaaactcctcttcacgattgatagcaaaatcagaaacgttagggcaccagtgagttgaaaaaactggtcttaagttggaaaaactattattaataatattatcctatccatccatatctattgaaattgtacaggtccataatttcattttaattaattataggaaagaagaaaagataatacccatttgttctatcacccctctccctatcattaactatcaaataaataaataaaagcaatctgatttccaacgtggtactaaaaaaaaag

SEQ ID NO: 2523 - DNA, 6068 bp, Homo sapiens
ggattcctttcctatgatgccaatcaaacatgcaatccagtggctttatccatatagtattttactaggtcatgaagggaagatggctgtggaaggtgttttaaagcgctttgaacttcaagattcaggaagctctctacttcctaaagagattgtaaaagtagagaagatgatggaaaaccatgtgtcccaagcttctgtgaccatccggattgcagataaagaggtgaccattaaggtgccagccgggaccaggctattaagtcaaccttgtgcgtcagaccgtttcatacagactttgagccataagcagctacaggctgaaatgatgcagtctcacatggttaaagatatatgtttaattggaggaaagggttgtggaaaaacagtgatcgctaagaactttgccgataccttaggatacaacatagaacctattatgctctatcaggatatgacagcgcgtgatctgctacagcagagatacacccttccaaatggagacactgcctggcggtcctcaccccttgtgaatgctgctctggaaggcaagctggtcctgctggatggcattcaccgggtgaatgcgggcacgcttgctgtattgcaaaggttaatccatgatcgagagctaagcctctatgatggttctaggctgctgagagaagacaggtatatgcgtttaaaggaggagctgcaactgtctgatgaacagctacagaagagatccatttttcctatccatccctccttcagaatcattgccttggcagaaccccctgttattggaagcacagcacaccagtggctgggaccagaattcttaaccatgttctttttccattacatgaaaccacttgtgaaaagtgaagaaatccaagtgattaaggaaaaggtcccaaatgtacctcaggaagctctggataagttattatcatttacacacaaactcagagaaacacaggatccaacggcacaatcattagcggcatcactttctaccagacaactgttgcgaatttctcgtcggctgtcacagtatcctaatgaaaatcttcacagtgctgttactaaagcctgcctttccaggtttttacccagtcttgctaggtcagcattagaaaaaatctggcagatgctacaatagaaataaatactgatgacaatttggagccagaactgaaggattacaaatgtgaagtaacatctggaactctgaggattggtgctgttagtgcaccgatctataatgcacatgagaaaatgaaagtgcctgatgttcttttctatgacaacattcagcatgtgatagtgatggaagatatgctgaaagactttctccttggagaacacttattattggttggcaaccagggtgtaggaaaaaacaagattgttgacagattccttcacctgctcaacagaccccgagaatatattcagctacacagggataccacagtacaaactcttacgcttcagccttcggttaaagacggacttattgtatatgaagactcacctttggttaaagcagtaaagttgggtcatattctggtagtagatgaggctgacaaagctccaacaaatgtcacgtgtattttaaaaactctagtagaaaatggagaaatgattctagcagatggaagacgcattgttgcaagtgagtattttagaaagcaatacctggatttcctttcctaggcaatgatttcttcggtaccttaggtgatatttttagctgccatgcagttgataaccccaaaccccactcggagctcgagatgctcagacagtatggaccaaatgtgcctgagcccatccttcagaagcttgtggctgcctttggagagctgaggagtttggctgaccaagggattattaactatccttattctaccagagaagttgtcaacatagtcaaacatttacagaaatttccgactgaaggtctctccagtgtagttcgaaatgtgtttgactttgattcctacaacaatgacatgagggagatattgattaacactttacacaaatacgggatacctatcggagcaaagcctaccagtgtgcagctggcaaaggagttgactctgccagaacaaacgttcatgggctactggacaattggtcaggcaagaagtgggatgcaaaaactcttgtgtccagtggaaactcatcatatagacataaagggtccagcacttataaatatacaggagtatccaatagaaagacatgaagaaagatccctaaactttactgaagaatgtgcctcatggagaataccattggatgaaattaatataatctgtgacattgctacatcacatgaaaatgagcaaaatactctctatgtagttacatgcaatcccgcttccctgtactttatgaatatgactgggaaaagtggcttctttgtggacttttttgatatcttcccaagaacagccaatggcgtttggcacccttttgtgacagtggcaccgctgggaagtcctctcaaaggtcaagtggttctccatgagcagcagagtaatgttatcctgttgttagatactactggccgggcccttcatcgtctcatcctcccttccgagaagtttacatctaagaaacctttctggtggaacaaagaagaagctgaaacttataaaatgtgtaaagaattttcacacaaaaactggctggtgttctacaaagaaaaagggaacagcctgactgtgctggatgttctagaagggcgaactcacaccatctcacttcccatcaacctcaagacagttttccttgtagcagaggacaaatggcttctggtggagagcaaaacaaatcagaaatatcttttaactaagcctgcacacatcgaatctgagggtagtggggtttgccagttgtatgtgctgaaagaggagccgcccagcacagggtttggagttacacaagaaacagagttcagcatacctcataaaatttccagtgatcaactatcatctgaacatctaagttcagctgtggaacaaaagattgcctctcccaacagaattctctcagatgagaaaaattatgctacaatagttgttggttttccagatctcatgtcacccagtgaagtttattcttggaagagaccatcatctttgcataaacgaagggcactgatacatcattctatagaggaaagaagaaaagggggactccaaaacaaagcaattgtgtgactcttttagatacgaatcaggtagtgaggattttacccccaggagaagtccctctaaaagatatctacccaaaagatgttactcctccacaaacatctggttatatagaagtcactgatcttcaatcaaagaaactccgatatatccctattcccagatcagaatctctctcgccgtataccacatggctgtcgaccatttcagacacagatgcactgctggctgagtgggacaaaagcggtgttgttactgttgatatgggaggtcacatcaggctttgggaaactggacttgaacgtctgcagcgatcactcatggaatggagaaacatgattggacaagatgacagaaatatgcagataacaatcaacagagacagtggtgaagatgtaagctcccccaaacacgggaaggaggacccagacaacatgcctcacgtgggcggcaacacttgggctggcggaacagggggaagagacacggcaggcctgggtggcaaaggaggcccttaccggctggatgcaggccatacggtgtaccaggtctctcaggctgagaaagatgcagttcccgaagaggtcaagagagctgctagagagatgggccagagagcattccagcagaggctaaaggagatccaaatgagtgaatacgatgctgcaacctatgaaaggttttcaggtgctgttcggcgacaggtgcactccctccgaatcatcctggataatttacaggctaaaggtaaagaaagacaatggctaagacatcaagctactggagaattagatgatgccaagatcattgatgggctgactggagaaaaagccatctacaaacgtcggggtgagctggagccacaacttggcagcccacaacagaaacccaagcgtctgcgcctggtggtagatgtgtctggtagcatgtaccgtttcaacaggatggatggccggcttgagcgcacaatggaggctgtgtgtatggtcatggaagccttcgagaactatgaggagaagttccagtatgacatcgttggacactctggagatggctacaacattggtctggttccaatgaacaaaatccccaaggacaataagcaaagactagaaattctgaagacaatgcatgcccactctcagttctgcatgagtggggaccacacgttagaagggacagaacatgccatcaaggaaattgtcaaagaagaagctgatgagtactttgtcatagtcttgagtgatgcaaatctgtcacgatatggaatacatcctgctaagtttgctcaaatcctcacaagagaccctcaagtaaatgcttttgccatttttattggctctttaggtgatcaagcaaccaggcttcagagaactttaccagctggtcggtctttcgttgccatggataccaaggatatccctcagattttacaacagatcttcacctccaccatgttgtcgagtgtctaagaagtgcccttcatcaccctgatgacaccaggatttgaaataagacaggaataaagagtattctgaaaaaaagaagatatggatgaagtgaacccatgcagtgactggatgattccggcattcctgggtcttcctacacttgctccgtaatgagaattcagagaagcagccagaaggagacttaaacatggaaagatactccactgatgagtttagaagtgattagggcaagctagttgacctgcactttatcaaaggttggggttaaaggaaggtggttttgagaactatgtgtttggtctatttccaaaaacctgagggggagaaaatactttgcttttgccttaacacatcatctggtcacgttagaaaagtgaccccatcaaactgagcctttgatgtcacattctgacacaagatgcaagtctgtgcaaaacccaccaaaatgctcctatccaacaattatttttattttctccctgctctgtattgaccagaaaacaatgattttataatatttaacccaccaaaaagtccctccaacagcaatatcttatgaaaggctggctgttctcaataatttcattttcttggccaaagccaaaaggaatcaaaaaatccttggagtgcttgcctttccacgtgacttttaaaaggctcttaaagagcaaatgtcctcttctccttgctgctagagtgggaggagaaagatgtcttgccttaaaagtttactgtttcttctgttcttctagcatctctcaaaaaattcacagtactccattttggggtccaaactgtaatgctcaaaataataaatgcttacacgaaaattatttattgagaatattcatataaaaattacctaaagcaaagtaaaaaaagtaaaatcaaggtggtatatttgaagtgaatggtgattggaaatttttagctgtaacaaaaagaaagaaaacaactttttttaaagcctcattctcttttctttcaaaatgtaccttattcccacacactcttgggctgacctttattttatcaataagctcaatattactttgtttaaaataagatgcttcagcaaaagtcattctctctttaaccatataatttaaaaactcctcttcacgattgatagcaaaatcagaaacgttagggcaccagtgagttgaaaaaactggtcttaagttggaaaaactattattaataatattatcctatccatccatatctattgaaattgtacaggtccataatttcattttaattaattataggaaagaagaaaagataatacccatttgttctatcacccctctccctatcattaactatcaaataaataaataaaagcaatctgatttccaacgtggtactaaaaaaaaag

SEQ ID NO: 2524 - DNA, 2403 bp, Homo sapiens
ggattcctttcctatgatgccaatcaaacatgcaatccagtggctttatccatatagtattttactaggtcatgaagggaagatggctgtggaaggtgttttaaagcgctttgaacttcaagattcaggaagctctctacttcctaaagagattgtaaaagtagagaagatgatggaaaaccatgtgtcccaagcttctgtgaccatccggattgcagataaagaggtgaccattaaggtgccagccgggaccaggctattaagtcaaccttgtgcgtcagaccgtttcatacagactttgagccataagcagctacaggctgaaatgatgcagtctcacatggttaaagatatatgtttaattggaggaaagggttgtggaaaaacagtgatcgctaagaactttgccgataccttaggatacaacatagaacctattatgctctatcaggatatgacagcgcgtgatctgctacagcagagatacacccttccaaatggagacactgcctggcggtcctcaccccttgtgaatgctgctctggaaggcaagctggtcctgctggatggcattcaccgggtgaatgcgggcacgcttgctgtattgcaaaggttaatccatgatcgagagctaagcctctatgatggttctaggctgctgagagaagacaggtatatgcgtttaaaggaggagctgcaactgtctgatgaacagctacagaagagatccatttttcctatccatccctccttcagaatcattgccttggcagaaccccctgttattggaagcacagcacaccagtggctgggaccagaattcttaaccatgttctttttccattacatgaaaccacttgtgaaaagtgaagaaatccaagtgattaaggaaaaggtcccaaatgtacctcaggaagctctggataagttattatcatttacacacaaactcagagaaacacaggatccaacggcacaatcattagcggcatcactttctaccagacaactgttgcgaatttctcgtcggctgtcacagtatcctaatgaaaatcttcacagtgctgttactaaagcctgcctttccaggtttttacccagtcttgctaggtcagcattagaaaaaatctggcagatgctacaatagaaataaatactgatgacaatttggagccagaactgaaggattacaaatgtgaagtaacatctggaactctgaggattggtgctgttagtgcaccgatctataatgcacatgagaaaatgaaagtgcctgatgttcttttctatgacaacattcagcatgtgatagtgatggaagatatgctgaaagactttctccttggagaacacttattattggttggcaaccagggtgtaggaaaaaacaagattgttgacagattccttcacctgctcaacagaccccgagaatatattcagctacacagggataccacagtacaaactcttacgcttcagccttcggttaaagacggacttattgtatatgaagactcacctttggttaaagcagtaaagttgggtcatattctggtagtagatgaggctgacaaagctccaacaaatgtcacgtgtattttaaaaactctagtagaaaatggagaaatgattctagcagatggaagacgcattgttgcaaattctgctaatgtgaatggaagagaaaatgttgtagtgattcatcctgattttaggatgattgttctggcaaatagacctggatttcctttcctaggcaatgatttcttcggtaccttaggtgatatttttagctgccatgcagttgataaccccaaaccccactcggagctcgagatgctcagacagtatggaccaaatgtgcctgagcccatccttcagaagcttgtggctgcctttggagagctgaggagtttggctgaccaagggattattaactatccttattctaccagagaagttgtcaacatagtcaaacatttacagaaatttccgactgaaggtctctccagtgtagttcgaaatgtgtttgactttgattcctacaacaatgacatgagggagatattgattaacactttacacaaatacgggatacctatcggagcaaagcctaccagtgtgcagctggcaaaggagtaaggcaaattcagtactcttctgattcttaaatgctgatagttcttgatttatcattccattctacaaaactgagttgctatggaaattactttccatgagtaagcttttcaaatacatgtatatgttgctgtttgctggctgcttttcagttaaatagcattatttataggcctgtaaattgaaaattttgattattatgtatgtcccatgagtagatgtaataaataaagggaaatatttgtttctttaaaaaaaaaa

SEQ ID NO: 2525 - DNA, 2438 bp, Homo sapiens
ggattcctttcctatgatgccaatcaaacatgcaatccagtggctttatccatatagtattttactaggtcatgaagggaagatggctgtggaaggtgttttaaagcgctttgaacttcaagattcaggaagctctctacttcctaaagagattgtaaaagtagagaagatgatggaaaaccatgtgtcccaagcttctgtgaccatccggattgcagataaagaggtgaccattaaggtgccagccgggaccaggctattaagtcaaccttgtgcgtcagaccgtttcatacagactttgagccataagcagctacaggctgaaatgatgcagtctcacatggttaaagatatatgtttaattggaggaaagggttgtggaaaaacagtgatcgctaagaactttgccgataccttaggatacaacatagaacctattatgctctatcaggatatgacagcgcgtgatctgctacagcagagatacacccttccaaatggagacactgcctggcggtcctcaccccttgtgaatgctgctctggaaggcaagctggtcctgctggatggcattcaccgggtgaatgcgggcacgcttgctgtattgcaaaggttaatccatgatcgagagctaagcctctatgatggttctaggctgctgagagaagacaggtatatgcgtttaaaggaggagctgcaactgtctgatgaacagctacagaagagatccatttttcctatccatccctccttcagaatcattgccttggcagaaccccctgttattggaagcacagcacaccagtggctgggaccagaattcttaaccatgttctttttccattacatgaaaccacttgtgaaaagtgaagaaatccaagtgattaaggaaaaggtcccaaatgtacctcaggaagctctggataagttattatcatttacacacaaactcagagaaacacaggatccaacggcacaatcattagcggcatcactttctaccagacaactgttgcgaatttctcgtcggctgtcacagtatcctaatgaaaatcttcacagtgctgttactaaagcctgcctttccaggtttttacccagtcttgctaggtcagcattagaaaaaatctggcagatgctacaatagaaataaatactgatgacaatttggagccagaactgaaggattacaaatgtgaagtaacatctggaactctgaggattggtgctgttagtgcaccgatctataatgcacatgagaaaatgaaagtgcctgatgttcttttctatgacaacattcagcatgtgatagtgatggaagatatgctgaaagactttctccttggagaacacttattattggttggcaaccagggtgtaggaaaaaacaagattgttgacagattccttcacctgctcaacagaccccgagaatatattcagctacacagggataccacagtacaaactcttacgcttcagccttcggttaaagacggacttattgtatatgaagactcacctttggttaaagcagtaaagttgggtcatattctggtagtagatgaggctgacaaagctccaacaaatgtcacgtgtattttaaaaactctagtagaaaatggagaaatgattctagcagatggaagacgcattgttgcaaattctgctaatgtgaatggaagagaaaatgttgtagtgattcatcctgattttaggatgattgttctggcaaatagacctggatttcctttcctaggcaatgatttcttcggtaccttaggtgatatttttagctgccatgcagttgataaccccaaaccccactcggagctcgagatgctcagacagtatggaccaaatgtgcctgagcccatccttcagaagcttgtggctgcctttggagagctgaggagtttggctgaccaagggattattaactatccttattctaccagagaagttgtcaacatagtcaaacatttacagaaatttccgactgaaggtctctccagtgtagttcgaaatgtgtttgactttgattcctacaacaatgacatgagggagatattgattaacactttacacaaatacgggatacctatcggagcaaagcctaccagtgtgcagctggcaaaggagtaaggcaaattcagtactcttctgattcttaaatgctgatagttcttgatttatcattccattctacaaaactgagttgctatggaaattactttccatgagtaagcttttcaaatacatgtatatgttgctgtttgctggctgcttttcagttaaatagcattatttataggcctgtaaattgaaaattttgattattatgtatgtcccatgagtagatgtaataaataaagggagatcgcgtcctgcttctctcctccttttcttccacttcaatgctgtgctatcatagtaga

SEQ ID NO: 2526 - DNA, 899 bp, Homo sapiens
  misc_feature (12)..(12): n is a, c, g, or t
  misc_feature (244)..(244): n is a, c, g, or t
  misc_feature (331)..(331): n is a, c, g, or t
cgaccccccacncctaaataagaataataactacggagacgaccacaaagaggacacacaaactaggtgatactgtcgtcctgactgcgcacagcgggtactcgagcgtaggagccccgagatccacgggtcagataggaaaaaagaggttcccgccccctggaatccaaaagagcgaacccaattggtttagccgggcccctttgggggaccccttagcctgtggttccgaagaactggatcncggcccctggaagcctacccttagtcagacctggtcccagttcactgaccagaaggtctgaagggctagcatttctgtggaggtggncaggtcttctggagcagcctcgtgccgaattcggcacgagatccttcagaagcttgtggctgcctttggagagctgaggagtttggctgaccaagggattattaactatccttattctaccagagaagttgtcaacatagtcaaacatttacagaaatttccgactgaaggtctctccagtgtagttcgaaatgtgtttgactttgattcctacaacaatgacatgagggagatattgattaacactttacacaaatacgggatacctatcggagcaaagcctaccagtgtgcagctggcaaaggagtaaggcaaattcagtactcttctgattcttaaatgctgatagttcttgatttatcattccattctacaaaactgagttgctatggaaattactttccatgagtaagcttttcaaatacatgtatatgttgctgtttgctggctgcttttcagttaaatagcattatttataggcctgtaaattgaaaattttgattattatgtatgtcccatgagtagatgtaataaataaagggaaatatttgtttctttaaaaaaaaaa

SEQ ID NO: 2527 - DNA, 720 bp, Homo sapiens
tccttagctgcataatggcaggctctatgcaaaaggatgaggttactgatttgataaaaactaaagaacttatcctttagctattccttggattctcccttattatggatttctatttttaatttttttaaggactaaaaacatctcaagccaggcttaagtactgtaagtctacatttggacaaggttgcttttttttagatgtactctgaaggtatataagagtgcaagtccctgtacaatttagtatatgctttatcagtgtttggttcttgagcaaattttttcaagaaagtttttgtttctgcaaccaagttatcacagccaaatatcttagagctttttacaattgaacagtataactatttatgttatctaaaagattgttgcttgatatttttaagaattattaaatattgataaagaataaacaaattttgtttttcagattctgctaatgtgaatggaagagaaaatgttgtagtgattcatcctgattttaggatgattgttctggcaaatagacctggatttcctttcctaggcaatgatttcttcggtaccttaggtaaaaacagtaatgataataacaataccaatagcagtaataataatattagtaacactgctgtaatggctgtcattgaatgcttatcatgtgctgtgccaccatcataatcaccttgtgagaatatttattatcccccttttagtgaagaa

SEQ ID NO: 2528 - DNA, 495 bp, Homo sapiens
agaaggtaatttgactgtttaattactagttaagtacaattaatatcctccacaaggctgtcctaaaaccatgacccaacttttgttctgtggtcaagttcagatttatcatctgaatttccacgttttccttccagggggaagagacacggcaggcctgggtggcaaaggaggcccttaccggctggatgcaggccatacggtgtaccaggtctctcaggctgagaaagatgcagttcccgaagaggtcaagagagctgctagagagatgggccagagagcattccagcagaggtcagtgctcccatcacatttagaccagcactactgctatggtgaaatgtcatgatggactgtggggaaacctagatttgtgtgtgtttccacctccacctcatgcagcaactcggacctcaaactgaaatccacagccatccccgtccctaacggaaacagccaaataaacaaaatcacctgttctttctactcaggctc

SEQ ID NO: 2529 - DNA, 281 bp, Homo sapiens
ttgtgtgtgtatgtgtgtcttttgtaggctaaaggtaaagaaagacaatggctaagacatcaagctactggagaattagatgatgccaagatcattgatgggctgactggagaaaaagccatctacaaacgtcggggtgagctggagccacaagtaagtcatggtgaactgctagcctcagctctgcatagtctagccctctttacagaaacttgctttcgtgagttgtgtcaaaatatcacaaatcctgaatatggtaaccaaggaaagcattatgttaa

SEQ ID NO: 2530 - DNA, 449 bp, Homo sapiens
tattgttccatatgttgaaagaattaaaacggacaaagggcatttatttgtcagcagagcagaaaccacttcatttatatgactgtgttcatgcagaaccatcacttactgaaaagatcccaggtgtgtttcctgttattcatgcacaaagtatgtcagagactctgcataactaattaaggctttgtgtgtgtatgtgtgtcttttgtaggctaaaggtaaagaaagacaatggctaagacatcaagctactggagaattagatgatgccaagatcattgatgggctgactggagaaaaagccatctacaaacgtcggggtgagctggagccacaagtaagtcatggtgaactgctagcctcagctctgcatagtctagccctctttacagaaacttgctttcgtgagttgtgtcaaaatatcacaaatcctgaatatggtaaccaag

SEQ ID NO: 2531 - DNA, 393 bp, Homo sapiens
cccactgcttctctgccctcatctcgtagcactccagccccggcccccgctggctggcctcccgtgcagcacgctctcccctcagggcctttacacttggcttctcccttgatctgggttgtgctcttccctatcttcccaccctctaatgtccatgtgccttcttcctcactttcttcagctctctgttcagacgtcaccttttctgtgaggccttccctgacctaacataaacagcaacaaggtcagtctcagtggctcacgcctgttatcccaaagtgctgggattacaggtgtgagccaccttgtccggccatcaatttttctgtaagcctaaaattgctttaaaaatagtctgtttaacttttaaaaataaattgaacatatatgtgt

SEQ ID NO: 2532 - DNA, 698 bp, Homo sapiens
agaacagccctcaagctgcggtacagcataactcatcaagtatcgtcggcctcctccttcaacaaaatataaatatcttttctcaagacctgttggccagactgccgaggattatgctgtttgttataatttcagaagcattcaacaacaaattttggaacataaaaataagatacttaaaagtcatctttgaaatgataatcaagaaacagcagctatgaagccttgaattttgaaaaaaagacaagaaggtgcaaaagtctttaatcctggcagggattcacgggcgcacacacacacactcaggattcagatcttgttgaaagctgcgatatcgacactctgcacgtgctcctcaaacttggtgatctcctccagcaagtctgtccccaccttgtcgtcctccaccacacactgaatctgtagcttccggataccgtagcccatgggcaccagcttggaggccccctagaccagctcttccagctggatggagcacacacaggcctccagctgggccatgtcagtctcatcgtcccaaggcttgaaatccagcaggatggaggacttggccaccagttcaggcttcttggccttcttctccgcgtactgctgcagccgctcctcctgcagctgtgccgccttcttgtcctcctcctcattgtcgctgccaaacaggtcagtgtcatcatcgtcgt

SEQ ID NO: 2533 - DNA, 460 bp, Homo sapiens
  misc_feature (53)..(53): n is a, c, g, or t
ctctacaggatcttagcaccgtctgagaatgtggcaggcctacgcacggcgcncgtacacacactcaggattcagatcttgttgaaagctgcgatatcgacactctgcacgtgctcctcaaacttggtgatctcctccagcaagtctgtccccaccttgtcgtcctccaccacacactgaatctgtagcttccggataccgtagcccatgggcaccagcttggaggccccctagaccagctcttccagctggatggagcacacacaggcctccagctgggccatgtcagtctcatcgtcccaaggcttgaaatccagcaggatggaggacttggccaccagttcaggcttcttggccttcttctccgcgtactgctgcagccgctcctcctgcagctgtgccgccttcttgtcctcctcctcattgtcgctgccaaacaggtcagtgtcatcatcgtcgt

SEQ ID NO: 2534 - DNA, 924 bp, Homo sapiens
agaacagccctcaagctgcggtacagcataactcatcaagtatcgtcggcctcctccttcaacaaaatataaatatcttttctcaagacctgttggccagactgccgaggattatgctgtttgttataatttcagaagcattcaacaacaaattttggaacataaaaataagatacttaaaagtcatctttgaaatgataatcaagaaacagcagctatgaagccttgaattttgaaaaaaagacaagaaggtgcaaaagggattcaagacgtctgactagaggcatctagcatttgcctcctccacaaagaagaaccaaaatagtgagtgatcacacttctaatagataatctaaaaaagaatactggaattcaacagagaagtaacaggaaacacctaacgcaaggaaagagagggaagagaggcagcctgcctggctagggttggctgggaacctcaaagaggctccacaatgtgggaaaaagtctttaatcctggcagggattcacgggcgcacacacacacactcaggattcagatcttgttgaaagctgcgatatcgacactctgcacgtgctcctcaaacttggtgatctcctccagcaagtctgtccccaccttgtcgtcctccaccacacactgaatctgtagcttccggataccgtagcccatgggcaccagcttggaggccccctagaccagctcttccagctggatggagcacacacaggcctccagctgggccatgtcagtctcatcgtcccaaggcttgaaatccagcaggatggaggacttggccaccagttcaggcttcttggccttcttctccgcgtactgctgcagccgctcctcctgcagctgtgccgccttcttgtcctcctcctcattgtcgctgccaaacaggtcagtgtcatcatcgtcgt

SEQ ID NO: 2535 - DNA, 584 bp, Homo sapiens
agaacagccctcaagctgcggtacagcataactcatcaagtatcgtcggcctcctccttcaacaaaatataaatatcttttctcaagacctgttggccagactgccgaggattatgctgtttgttataatttcagaagcattcaacaacaaattttggaacataaaaataagatacttaaaagtcatctttgaaatgataatcaagaaacagcagctatgaagccttgaattttgaaaaaaagacaagaaggtgcaaaagggattcaagacgtctgactagaggcatctagcatttgcctcctccacaaagaagaaccaaaatagtgagtgatcacacttctaatagataatctaaaaaagaatactggaattcaacagagaagtaacaggaaacacctaacgcaaggaaagagagggaagagaggcagcctgcctggctagggttggctgggaacctcaaagaggctccacaatgtgggaaaaagataatatgatcttatatttagaaaaatctaaagacttcaccaaaaatctcccatcagtaaatttagtaaagttgcaggagacaaaattaacatacaaa

SEQ ID NO: 2536 - DNA, 370 bp, Homo sapiens
ggaaagtggcagtttggtttttacggccttgcagtgtatggagatggttaccacagctcccattgttttagagcagttcttagattggacagcagtaactgagtctgatagatgcttgtataccagtagctacctctggctattgtgcgcaggaggtgttccataaatacttttcaaacaaaagaatgaaggagcataaaaggaaagaattaaagtaggtaatatatgagaattcttcctgctcaggtgtctctgattggttgtcatggattcttcaaatgcttctgtgatacatcataaagatcatgttggttctcttcaatctggccaccctaacttgtggattgctgagaaatccccaaaacccata

SEQ ID NO: 2537 - DNA, 396 bp, Homo sapiens
gccaatcacctttccccatgccttagaccaccctgcttctctaacccataaacatctctatgccttattttcgggaggcagatatgagagctatttacctgcccccttgctgggctgccttgtggataaatcttttctcttttgcaaaatgtgccatcacagtgattggtttacccagcacgggcagaacaaacctggttgataatttttctcatcctcgccaacacttactgtcattgtctgtgtttttcactatagccatgctggtggatatgaagtggcatctgattgtggttttcatttcatttcccttgtgactaatgagcctattttttgtgcttattgattatttgcatatcttctttaaaaaatatgtgttcgaatactttgcccatt

SEQ ID NO: 2538 - DNA, 411 bp, Homo sapiens
atctgggtgccatgttttataaacacaattattcactagtagtctttcaattctgcctttattacatgatgatctgctaattcagaatgagaaatttccacattaagtacttggcaggactgggtgtggtagctcatgcctataatcccagctacttgggaggctgacacaggagaatcacttgaacctgggaggctgaggttgcagtgagctgagatggagccattgcactccagcctgggcaaaaagcgaaattccatcccaaaaaagaaaaaaaaagatcttggcaggccaggcgtggtggctcatgcctgtaatcctagcactttcggagggcaaggtgggtggatcacatgaggtcacaagttcgagaccagcctggccaacatggtgaaacccccatctctacta

SEQ ID NO: 2539 - DNA, 2787 bp, Homo sapiens
accttcagcaccgtcctgcaggactgcaagaggaccttggagagagcctatcagatgggctggacccccaacatgtctgccgcctcctcctagcgctcctgcctcgcctagtccactgggatcattcagcagagcagaggagaattgtacatttggggagctgatctctcggaagggttttaactgtcacctgtctgtgtgtgttcaagtatgtgtatttgtgtcttgtttgcatactgcataccaaaagtgcagttgtcatttgttcccaagtgagctggctttttttcttagaaattaaagattatgaaagccacaaactttttagtttttaacttcaaaggcttctttctcttttaaaaaaaattatttttaatatagagtcaaaaaattggatgtattattttgagcttctaattgctgccacttggagatgtccaagtaagaaggccttctttttacatgggatgaattgtgcacttctactgatgatgactacagcagaagtgatgttatacgtacaggcacttacactctctcacatattcacacgtgtgcacatctacaccagggctctgatctactctagatcgtttcctgacagagaagccttcttccaggccactaaggtagcatgttatccactgtggcactgcctaactccgtgtatcctcgggtggccaacttgctatctggtgggtgacttggggactagaaagaataaagccttttctaaatttgttatatagaggcaacagtctgaactctcctggccagctcacgaaagttaattatacattattctacaaatgcattctgttgagcactaaatattttagttggttttatgttaaccattgtgttagcttttatttcctggatagtaactggtcaggatatattttaatgatatttgaaactaatcttagcattgaagccaccaatgtaattaatggtgtgcagttattttaaaaactacagatcatttcattattttcttaattttggtaattattaaagtctatttctgagatacgagagggtagtcacattaatagaagattcatgagtgagatataagtagacaatctttctactgttgttgctctttttgctttgctttgggttcttgaacaggttttttggatatatgcatgttgtcattttggactagttctcatgctactgcaaagatctattgctagctaatatatgagttaagaaagaaaattagaaaatctgttcattgaaattctgtttacacttgtcagaaataagcatttctttgtttaattaaggattgccagcttcagttaagacaagacctatcagtaaatgaatatatgttttgatttaacacatctttacaattaattcataatagggactcaggctcaaataactgttcctgtgtctagatttataatgaggacatcagggagcctttttaagctaaagagtgattatctttcacagtagaactagaaacaaaaccctaacttgtgaagttgctatttatttttccctgagtgaatataactgttatttggtctttaacagatatactgaggtttgagtttcactttctttaagtctcacattgctaacatgacattagctgtaagaaacaagatagctttacatttgaatgccatttactgatttctaatgattctctttttttgtaaacaactgtttcctttgattatgtcaacatgtttctgatgtggcatttttgttttaatcccaatcggttaggaaaatctagtcagtaagcgccatgagtattcttcccataactaaatgggtttctaatttaatttgaagggaataaaatttgtgtaagaaaaaagctgtttaacattaataaactatatttcttcttacacattgaactgtatcattttcatatccacttccccaccactgaaatatcttatttcacaatattttaactgatttttaatccaaaactaatttataagacagtatgtatagtaatagtagcttgagtgaatatgcaaaagtttaatttttatatatgtcatactatattttaaatagttaaaaaagacaaaagaagggagagccatctatgatatagatggtaccatttcagttcaaagttgtaataacctttggagtgttacagtttggttgtcaaatggtttcagaatgtataattgatttttttaaatgttgcattgtttgaatctaaagtacagcactataacatgctttagcttgggggggtgggggtggggtggggacttgcacttattctctaaaatgttgactaatccagaaagcctgatgcaacataatctggaaaactgctttggtacatttgtagaaatccgtagaaataccatatccagcctcaaagcattaatctcaaaaaaaaaaaaaaaaaaaaaaaaaaaacagccagaaaaaagcatcaccttgagtggtcctgtgatggttgttgaatgtgttctcattagatgctttgaaatgaggcttaaaataatttttctgggcaatatagagtttcttttttttgcttagaatgtcataaatacatgtgaacacgtttaatgcagggctttttattctctccaaaatgtcaacagtattttcagaataaagactatgaaatatattgctgtagtggaaaattctggtcctttgtctttaatgtctttttgagtggataaagaaaattcacccggtttgtagtttctatatttccgtgaatctttgaccttgcaatgggttgcaataaaagagaaacaaaaaaaaaaa

SEQ ID NO: 2540 - DNA, 3405 bp, Homo sapiens
  misc_feature (3141)..(3141): n is a, c, g, or t
  misc_feature (3237)..(3237): n is a, c, g, or t
accttcagcaccgtcctgcaggactgcaagaggaccttggagagagcctatcagatgggctggacccccaacatgtctgccgcctcctcctagcgctcctgcctcgcctagtccactgggatcattcagcagagcagaggagaattgtacatttggggagctgatctctcggaagggttttaactgtcacctgtctgtgtgtgttcaagtatgtgtatttgtgtcttgtttgcatactgcataccaaaagtgcagttgtcatttgttcccaagtgagctggctttttttcttagaaattaaagattatgaaagccacaaactttttagtttttaacttcaaaggcttctttctcttttaaaaaaaattatttttaatatagagtcaaaaaattggatgtattattttgagcttctaattgctgccacttggagatgtccaagtaagaaggccttctttttacatgggatgaattgtgcacttctactgatgatgactacagcagaagtgatgttatacgtacaggcacttacactctctcacatattcacacgtgtgcacatctacaccagggctctgatctactctagatcgtttcctgacagagaagccttcttccaggccactaaggtagcatgttatccactgtggcactgcctaactccgtgtatcctcgggtggccaacttgctatctggtgggtgacttggggactagaaagaataaagccttttctaaatttgttatatagaggcaacagtctgaactctcctggccagctcacgaaagttaattatacattattctacaaatgcattctgttgagcactaaatattttagttggttttatgttaaccattgtgttagcttttatttcctggatagtaactggtcaggatatattttaatgatatttgaaactaatcttagcattgaagccaccaatgtaattaatggtgtgcagttattttaaaaactacagatcatttcattattttcttaattttggtaattattaaagtctatttctgagatacgagagggtagtcacattaatagaagattcatgagtgagatataagtagacaatctttctactgttgttgctctttttgctttgctttgggttcttgaacaggttttttggatatatgcatgttgtcattttggactagttctcatgctactgcaaagatctattgctagctaatatatgagttaagaaagaaaattagaaaatctgttcattgaaattctgtttacacttgtcagaaataagcatttctttgtttaattaaggattgccagcttcagttaagacaagacctatcagtaaatgaatatatgttttgatttaacacatctttacaattaattcataatagggactcaggctcaaataactgttcctgtgtctagatttataatgaggacatcagggagcctttttaagctaaagagtgattatctttcacagtagaactagaaacaaaaccctaacttgtgaagttgctatttatttttccctgagtgaatataactgttatttggtctttaacagatatactgaggtttgagtttcactttctttaagtctcacattgctaacatgacattagctgtaagaaacaagatagctttacatttgaatgccatttactgatttctaatgattctctttttttgtaaacaactgtttcctttgattatgtcaacatgtttctgatgtggcatttttgttttaatcccaatcggttaggaaaatctagtcagtaagcgccatgagtattcttcccataactaaatgggtttctaatttaatttgaagggaataaaatttgtgtaagaaaaaagctgtttaacattaataaactatatttcttcttacacattgaactgtatcattttcatatccacttccccaccactgaaatatcttatttcacaatattttaactgatttttaatccaaaactaatttataagacagtatgtatagtaatagtagcttgagtgaatatgcaaaagtttaatttttatatatgtcatactatattttaaatagttaaaaaagacaaaagaagggagagccatctatgatatagatggtaccatttcagttcaaagttgtaataacctttggagtgttacagtttggttgtcaaatggtttcagaatgtataattgatttttttaaatgttgcattgtttgaatctaaagtacagcactataacatgctttagcttgggggggtgggggtggggtggggacttgcacttattctctaaaatgttgactaatccagaaagcctgatgcaacataatctggaaaactgctttggtacatttgtagaaatccgtagaaataccatatccagcctcaaagcattaatctcaaaaaaaaaaaaaaaaaaaaaaaaaaaaccggccaaaaaaagcttcccttgggggggcccggggggggtgggggaggggttccccttaaaaggttggaagggggctaaaaaatttttgggggcaagataatagagtttctttttttgcgctcagacgtgtcttaacttccgtgttgacccggtttaactggcaggggtttttaattccttctccaaagtgtgtcaccggttttttcaggaataaagcactatggaaatattttggcgcgcggggaacaattccgggccctttggcttcacagtgctcttcgagagggtataaagagaattacccccgggttggaagttcactatatatacccgggaactcttgggcccttgtgcaacgggcgcgtttcgcaacttaactaggagcaaccgactaagaaccatataagctaaatacacacacacacactcaacaacaaacaaagaaagggcggggcgggccgaaataaaaaaaatctcctccagagggggggccaccaaaatatgcccgaccaccccgtttttttgtgtcaacaacagggcggcgccataaagaggagcgagcgatataaacagacagagccgagcgcggcgccgttaaaacaccacgcgtggtcgtgctgggaaacacgctgctctggagcacctcgtggagagcagcccccatcttctgggcgggcgcacatgtggggcaccaccccaacgagagattaaaganccgggggactatcaaacacttggctgttcaggggccaaccaccggcgcatgctcgcggcgcaaacattggtctccgacttgttttgaacatagccngtcgcttctatcataccaaggaagtggcgacgaagcagagatcgaggatcaagtagtatcatacgatcatgtcgaactgtaagacgacacgaagcgacgagagcgccatcacaatccgagtacgaggatcaatcgtcgacatgccagcgagacacggcagtgatgtac

SEQ ID NO: 2541 - DNA, 384 bp, Homo sapiens
ctgaacatggcccagcttgtcattgtgaaggtgacattggttcagtgattgcttaaatggcatgtggaccgtgggaagcagtaggagcgtagtaagacagttggctgccattcaacatttcaaatagatggtttactcaaatcactcacttctggttgatggtaaagagagcagatggcttagaaaacatgatacaggaaaatttagtatgtaatccagtaaatatcctaagttatttattttcatgtgtgtgtgtgtgtttaaatcaagtaacccttttaattgaattttaaaatgacagcgaattttgacattctgagaaatggggattttgagatgtttctctccatatctccctttgtcctgtgtgtgtggccgacgccc

SEQ ID NO: 2542 - DNA, 2557 bp, Homo sapiens
cttagccttgggtgtctagaactagagccaatgtctgatgttaaagtgataacatttatttggaagataagtccagggcagcaatggccaggacatgtggaaattgaggcaaagcaaatgtgaaaccatgtcttgtgatgtatgatatgactctgctgatgaccacttcacaatgagatgagagagacagcatggtggtcatcagatgcgtggacttgactcccagtacttttccagaagggctgcaaggggaaaccacagccggcattagtccacggaagagaaagagaagagaaaatgtatctgctcagctgtcttctgtcttctatttcccattggccagggtttccctgaggcagaactaccatctctgctgttctgcgttccatcatccagtcccttggtggtagttatgaaagccaaacctcatgcccccagtgtggtgttccattgaagtcccaaatggaaggatgatctggatcaagcaaggtgctgaccaagaaaagagaagacagtcaagataatctgaggaaggatatgtttgtgggcaatactgtccactccttgtgcaactcagattggctcatgccctccaatcatggctggctttataggcatatgacttcacagttgcacagggtcttgtgcttagaagtgcttatgcttagaggggctttatgcttggattaatcttctgcacttgctgttttgtttttcagacagaaggtagtcctctgctggagaaggaatagtcttccactaattcgctaggagtttgctctccccactcctatgggcttgtgagaggcatgcacagagtcctataatgcccactatgcatgcctgtagcaactttgaattctgttacatcatctggcacaatggccaagcaacttgggccagactctatatctgctatagagcccgtttttgtttcgggtttgacttgagacaagcagcccttgcaaactcctttagtgagtcagagaaatatccttaaatgtggtatatgttgaattcaaaaccccaataagcccccataaaactgtatttcccttttagtgataggaagtatatatatatagggcaacatgccatttactgtaaaaaggatgttttgacaaaaggaccagaagcattggacccctataaacttcatctatgttataggtctttgaatctgctgaagtttatgtctcttcttccagtattttacttctgttcaatgttataatattttactatacttaaggaacttgccacttcctgcttatgggtaccactttatgtaatattattaatatattgaattaacatgatgttttgcaaaatgtcaattaaactgaaagcagaagtgacagccctgacagaaaacagtgaagcagtgttcttgtttttaccacaccaaagcaaattgttttgattttcctccacaatgtgtgtagattaaaaagcattagctaaatcaaaagccgcatacaaagtgctggaaaccacattctgctcagtgaagataccacatcctagagcgaatgtgcaagtgtgacttaagtttatgctaatgtgcattcatcctataatccatctggttttgacagaggccagttaggttaactgaataaagatataaaatggacgaccgccccctggaacttttgagttttttgttgtggcagcgaccaattctgtttcctggagaatgcagttattatgttttattcattttattgccaggaaagtagaatttcagaagcctccccttggtcctgcttacaataatgtcccttggtatacaggtcaggaagaaatgtaagagtcctgacagctgttgaacctgtcaacttcaattacactttcaggaaggggtaactacgatgaactcattagaacccctttgggttggacatgggccaaagctctatgtaccatctgatcttcaaaaactcatactccagtcctattgaggcagctcatacctgtaatcctaataatttaggaggccgaagtgggaggatcactttaggctgagagtttcagatcagccttggcaacatagtaagaatctgtaaaaaaaaaaaaaaaaattagttgtttgtggtagtgtgtgcctgtagttacagctacccagaagactcaggcaggaggattgctttagcccaggaattcgagtttgcagtgagctatgatggtgtcattgcactccagcctgggcaatcaagcaagatcttgtctctaaaaagaaacaaacaaaaacaacaaacaaaagcccaaaaagggcctggtgcggtggctcatgcctgtaatcccagcactttgggtggctgagtggttggatcacttgaggtcaggagttcgagatcagcctggccaacatggtgaaaccccacctctactaaaaatacaaaaattagccaggtgtggtggtgttgcacctgtaatccaagccacttgggaggctgaggcatgagaatcacttgaacccgggaggcagaggttgcagtgagctgagatcatgccactgaactccagcctgggcgacagagcgagtctccacctc

SEQ ID NO: 2543 - DNA, 421 bp, Homo sapiens
agtcaatgattataataacttcttttttaatttagaagggaaataaaggaaggaaggggagaaaaggaagtaatgaagtgggggaaaggaaggaatgaaggaaggaaagaagcaatattaactatagtaactgtagttggtactatttatggaacacttgatatttcaggcattatgatttgcaaaaattatctcataatatccccattttacagagggaaaattgaggttcagggagattaactattcaagactggcacttcaaaattagatactttttttaaaaaaatgactaaaacttggaatttttataaatatatatcactgaaaagggccagacgtggtggctcactcctgtaatcctagcactttaggagcctgaggcaggagaatcacttgagcctaggagtttgaaaccagc

SEQ ID NO: 2544 - DNA, 589 bp, Homo sapiens
ctgaggctgttcccgtctccagtctttctgctacagggcgctgtatacacttcctatcgcgtagtttctgtgctcaaaaccgttttttaactcctccctccccgcgcttttcaaagtcctcacccgagatgtgtatttccgcctgggcgcctcccagtctcaacctttaggcgcctgaagcgcaaacgtcgcgatcccagtctcagggaggccgagttctctgcctggtgctgggatcttgtggaccccaccgaaggcgtcgtcgcaccccacctcccgcctcatgctgggccttgctgcaccccaagtctccccttagcagtcaccactttccttgagccagcgttggggaggtgccaggggccagtcctgtgacacggtgtgttcttgcctgcctagctccaacccctgaaaaatgagcctctctgggatgcaggcgtcttacttcaaaccctcctgtgattgtgtgggctaaagagatcaggagacagagagtagtagaaaacctgagacagagaaaagaagaatgagaaagacccataacagatggcaaagtagaggatgggtgagggatttgccaagagacagc

SEQ ID NO: 2545 - DNA, 307 bp, Homo sapiens
ttggccaggctggtctcaaactcctgacctcaggtgatccgcccacctcagcctccctaagtgctggattacaggcatgagccactgtgctcggcctccagccacccatttctaaagttgagatacttcaaaagtattatggatgtctctcacataatctcatctaatagaaagattatcttttttagacagtagcagaaacagcagttttagtttgcaaaagaaacactttaactggatattagtggccaagtaaaaaaattaagtaaataaaagacgtagtaaatccctaaaccaaattgggcat

SEQ ID NO: 2546 - DNA, 875 bp, Homo sapiens
agagtaggtctgagatgtggtttctttgtttgtaaaattagggagttggactaggtcgtctctagtccagctacagatgttgtatcttatgttactaaatttcaagtggctttttctctatttatacaaaactcaaagttgcttgcctgtgtagatccccagattcagtatttttcagtcacgatgtagaagaatatttggagtacacatttagtgcttactggaatcattgacaggctgaagcttgtccatttatttttccttaattaccttccccaaacctgctcctcctccaattcctttatcgtttggtggcatcaccagcttctcagttactggactcaaagccttgcagctgtcttcagttattccctctcccttgtccctaacattaagtcagccataaaactcattgggggcacctgctgatgcctgtcccacctgtgcccttctattttttgaaggattcaactccatgttcttgccttcacagatctcgagctccagctgtactagaccactcactctttccctgcttgcccagtgcttgcagcagagtgggtgctccataattgttatatgaaaaaaaaaaaaaaaaaaaaaaagagcaaggcaaagcaaagcagagcgaagcaaagcaaggggtggaggaagctgtggtctcagccctgtattgcctgtgctgctccctctgctgggggagcttttccctgcatcctgccaggccatctcatccacctggactttccacccagctcaatcaactctgtgaagtttctcgtcatcgcccttgtgctcgcagagtatcttgcttattcaacttcatagtatttgtcacattggccttgagtgacagccaggtagagtgatttctc

SEQ ID NO: 2547 - DNA, 439 bp, Homo sapiens
atgggctgcagaatgggtgttgtgttaaaaagtacacaaacaaggagatttacaaatcttgtacgtctctataagagttctagggtgatcaagaccagtatcaatgagcactaatattttgttgtatgagcactacatctcaacagtgggcctaaaatatttaataaaccattggtgaaaatagatgtgctgtcatccaggctttgttccatttataggcaaaatagatttagcataattcttaagagctaggattttcaaaatggtaaatgagctttgacaccaacttaaatttatgtttccccctaaaaaggaagtgagcctgtcctttgaagccaggcactgacttctcctctctagctatggaagtcctagatggcgtcttcttccaatataaggctgttttatctacatttagaatctgttatttaatgtagcc

SEQ ID NO: 2548 - DNA, 431 bp, Homo sapiens
gatcagaggaacattagtttaagccatgaaaactatttgcattagtatgtgggtatgtgtgagagagagagagcacatgcatgggagagtgagatagccagcaagtgattataataaagcagagagacagagactagaaagcagggaaacttttgttttctaccatgactaataacaatttggttcaacatgtatattaaatacctctcagattaaatcccagagtgctccagaaattgtaaagattggctatatctgtgcaatcaagaggctcacggggtgagttaaatgagtaaaaactagtaagacaaaatgaaaagctgacggagccatacgtaaatatggaaatactctggaagcatggaggtggaaataatttaacttcttaggattaaagaagcctttaatcaaagagaagggggatgtttatc

SEQ ID NO: 2549 - DNA, 3226 bp, Homo sapiens
  misc_feature (196)..(196): n is a, c, g, or t
  misc_feature (2538)..(2538): n is a, c, g, or t
cgttatttttttaatctgccagaacatacatttttcttacctgtcattattattattattatttgaggtggagtcctgctgtatcaccaggctggagtgcagtggtgcaatctcggctcactgcagtccctgcctcctgagttcaagcaattcttgtgcctcagcctccctagtagctgagattacaggcgtgtgncaccacgcccagctaatttttctatttctagtagatatggggtttcaccatgttggccaggctggtctcgaactcctatcctcaagcaatctgcctgccttggcctcccaaagtgctgggattagaggcgtgagtcacctcgcccagcctcttacctgtcattcttgaggagcccagtgtaggagggaagggctgtgtatctgtgagtgcgggtaaagcacacggaagctggccatgttcgtcatcttggtttcatactgacaagcaggagtcagtgtgccccatggcgtgggggccctggaaggaagcctctgcagctgcagaaagacagaccccacttggaaaataaaacagcagcataaggacttgggctctaattacagagttgtcaggttgaagagaagtggttgtgggataacaggaagagaaaatattttggttcttctcagcataatgaattttcatcagtacgcctatttccttgtttagctttttgcgcaaatgtggacctttcgcctcctcctgtgtgctcttccttaaaaccctatttctccaattgttttatagatcagctttgtcagagcttgggcgtcagaggtcattgctgttcttgtattgacttgttcatttgttctttatccattcacttgttccctgcatattttgaaagtgttttgcattgcattgaactggagacaggggatacaaaagacaagccctgcttttgtcactcagtcctgtggcccagtttcctttcgcgcttttctcttccaatggtggggagaaggatccagagctccctaggtgcactgtccagaaaaatggaaaagtgaagtcaccatgagaacacgaagttcagcgtgagagtaccagcaggtaacagttattgagtacttactccaggccccggcattgtcctgtgccctgtacgtaaattaaggtcttcggatctcatgatgccaggaaaccccagccccacccactagtcttctctgttctgcctctggtctttctgtttctcccctctgttcccagtgtcctcacccgaatccacatctgtgaatgtccctctgaaccattgccgaaactttctagctagtctcctttcagcctcttctcctgtccagttctcacgtctttgtaaatttccatgtcacttttttgcttaaaaccatcaggaacaatgccttttaacagtagactttcaagagagcgtctggctttatcttccttctttattgtgaatctcatgagggcaacaagttataaatacttggcttcccaacaagcgtaggatagtgcctggcacacagcggccatccttgatgttgagtggatgcatttccttgcagttcccaccatgcagtcagcagcgccaacccatgtaggggacctttgatcattccccagttctctcagcctcttctgactcagttccctgtccccataaaagtttgttcctcccctgctgttttggctgtgagagaatgctgacaacaccagcaaaccaccacgcggcgagtgcttcagtatggggccgtggcctgtgcattccataaccctgctgcctggcccagtgtgtagcacctgatgtttgcaatcatgttcgtgcagagttcacatatttgctctgttacttttttatttaattgaggtgaaattcaaagaacagaattaaccgttttaaagtgacccgtgcagtagcatgaagcactttccctgcatgtgcggtccccacctctgcctagcaccagccttcccatccctccactctgttgtttaccagctctgtgacattgtcagctgcttcctctgtaagacgtgactgcgaattctgacctgccaggtttgaggcacaggacttgcacacggccagtgcagaagtcccataagaacataacctacccaaggccagctcacctctctgttacatatgctcatgagattagtgctatagactcagtgtgccacttccctgcacatgcgagggacgacagtgtcctgacacagcagtgaacccagtgtggtgccaaggagaaagttgtttttttggggccagccagcacacatggggtggcttgtccaataccctcaccggtccagatatttaatactcaaaaactgtcttctccaaagctgtcttctccactgtccatcaagttggggtcatgaagcatttttcttaaaggggaatgagtagaaattgcttagctatattctactccatccagtcttgctcaaggagaggtctgctgcaagcaagagacggcggctacacccctactggaagtgcttgacctgcaggaggcacagctgccctagagttaaccttgaggggtacnttatttttgatctctgaagcccactgtggtttctgctgccttggtggagaaggcagtgcaggtacaggagactcacatccagcccagctcgccctgctgctgggggcctcaggcggtggggatgcaggagaggctggcgggctgccattgcacactgctgccggcctggcctctggacacatggccagtgtgcagggtgctgtcccggggatggtgatggttgcacttcattcattccatccacaggtgtctgtggagggcccacgacgtgtcagttgtggtgcgttgtggtgtgcaggacagggaaggtacctatgcctcatgcagcagtggtatagtcatgtgagagtgactagtcatttctgaagcatcttcaacatcacattaaaaaaaacttaaattaggccgggcatggttgctcatgctggtaatcccagcactctgggaggccgagtcgggctgatctcctgagctcaggagttcgagaccaccctgggcaacatggtgaaaccccgtctctactaaaataaaaaaatatatatatattagctggacatggtagcacaagcctgtagtcccagctacttgggaggctgaggcatgagaatcgcttgagccccagagacagaggttgcagtgagccacaccactgtactccagcttgggctacacagtgagactccgtctc

SEQ ID NO: 2550 - DNA, 2922 bp, Homo sapiens
  misc_feature (2234)..(2234): n is a, c, g, or t
gaggaatgaacaactccagacgcgctgccttaagagctgtaacactcaccgcgaaggtctgcagcttcactcctgagccagcgagaccacaaactcaccagatgcaagaaactccgaacacatctgaacatcagaagggacagactccagacgcgccaccttaagagctgtaacactcaccgcgagggtccgcggcttcattcttgaagtcagtgagaccaagaccccacttggaaaataaaacagcagcataaggacttgggctctaattacagagttgtcaggttgaagagaagtggttgtgggataacaggaagagaaaatattttggttcttctcagcataatgaattttcatcagtacgcctatttccttgtttagctttttgcgcaaatgtggacctttcgcctcctcctgtgtgctcttccttaaaaccctatttctccaattgttttatagatcagctttgtcagagcttgggcgtcagaggtcattgctgttcttgtattgacttgttcatttgttctttatccattcacttgttccctgcatattttgaaagtgttttgcattgcattgaactggagacaggggatacaaaagacaagccctgcttttgtcactcagtcctgtggcccagtttcctttcgcgcttttctcttccaatggtggggagaaggatccagagctccctaggtgcactgtccagaaaaatggaaaagtgaagtcaccatgagaacacgaagttcagcgtgagagtaccagcaggtaacagttattgagtacttactccaggccccggcattgtcctgtgccctgtacgtaaattaaggtcttcggatctcatgatgccaggaaaccccagccccacccactagtcttctctgttctgcctctggtctttctgtttctcccctctgttcccagtgtcctcacccgaatccacatctgtgaatgtccctctgaaccattgccgaaactttctagctagtctcctttcagcctcttctcctgtccagttctcacgtctttgtaaatttccatgtcacttttttgcttaaaaccatcaggaacaatgccttttaacagtagactttcaagagagcgtctggctttatcttccttctttattgtgaatctcatgagggcaacaagttataaatacttggcttcccaacaagcgtaggatagtgcctggcacacagcggccatccttgatgttgagtggatgcatttccttgcagttcccaccatgcagtcagcagcgccaacccatgtaggggacctttgatcattccccagttctctcagcctcttctgactcagttccctgtccccataaaagtttgttcctcccctgctgttttggctgtgagagaatgctgacaacaccagcaaaccaccacgcggcgagtgcttcagtatggggccgtggcctgtgcattccataaccctgctgcctggcccagtgtgtagcacctgatgtttgcaatcatgttcgtgcagagttcacatatttgctctgttacttttttatttaattgaggtgaaattcaaagaacagaattaaccgttttaaagtgacccgtgcagtagcatgaagcactttccctgcatgtgcggtccccacctctgcctagcaccagccttcccatccctccactctgttgtttaccagctctgtgacattgtcagctgcttcctctgtaagacgtgactgcgaattctgacctgccaggtttgaggcacaggacttgcacacggccagtgcagaagtcccataagaacataacctacccaaggccagctcacctctctgttacatatgctcatgagattagtgctatagactcagtgtgccacttccctgcacatgcgagggacgacagtgtcctgacacagcagtgaacccagtgtggtgccaaggagaaagttgtttttttggggccagccagcacacatggggtggcttgtccaataccctcaccggtccagatatttaatactcaaaaactgtcttctccaaagctgtcttctccactgtccatcaagttggggtcatgaagcatttttcttaaaggggaatgagtagaaattgcttagctatattctactccatccagtcttgctcaaggagaggtctgctgcaagcaagagacggcggctacacccctactggaagtgcttgacctgcaggaggcacagctgccctagagttaaccttgaggggtacnttatttttgatctctgaagcccactgtggtttctgctgccttggtggagaaggcagtgcaggtacaggagactcacatccagcccagctcgccctgctgctgggggcctcaggcggtggggatgcaggagaggctggcgggctgccattgcacactgctgccggcctggcctctggacacatggccagtgtgcagggtgctgtcccggggatggtgatggttgcacttcattcattccatccacaggtgtctgtggagggcccacgacgtgtcagttgtggtgcgttgtggtgtgcaggacagggaaggtacctatgcctcatgcagcagtggtatagtcatgtgagagtgactagtcatttctgaagcatcttcaacatcacattaaaaaaaacttaaattaggccgggcatggttgctcatgctggtaatcccagcactctgggaggccgagtcgggctgatctcctgagctcaggagttcgagaccaccctgggcaacatggtgaaaccccgtctctactaaaataaaaaaatatatatatattagctggacatggtagcacaagcctgtagtcccagctacttgggaggctgaggcatgagaatcgcttgagccccagagacagaggttgcagtgagccacaccactgtactccagcttgggctacacagtgagactccgtctc

SEQ ID NO: 2551 - DNA, 1615 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggctta

SEQ ID NO: 2552 - DNA, 908 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttaca

SEQ ID NO: 2553 - DNA, 853 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaaccccca

SEQ ID NO: 2554 - DNA, 946 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagttcttccttgagacactagaagcttgccaaagggccagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttaca

SEQ ID NO: 2555 - DNA, 938 bp, Homo sapiens
aaaaggagagagtggcctagcctccctcccagcctacatctttctcccatgctggatacttcctgccttcaaacatcagactccaagttcttcagttttgggactcggactggctctccttgctcctcagcttgcagacatcctattgtgggaccttgtgattgtaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcaggctaatattaaaaaaatgcttactagtggtagaaggtggtgacaaagaaatactctgggtagcaggaggaagccaacttggattaaaattttgctgagaataatctaaaaagaaatatgtggagggatcttctgagaaatacctggaaacggatgcgaggatcccaaggcacagtgctggccagctggacactatggagctcttttctctactttactaatcgggatgtcaatccttctatcgctgtcctggagaaaccctcccacgtttatggccacaagactagatgcgataatcaacgagaagaattctgaacccaaggaagtcaacgttaagatggcccagtatcgcatccctgggtaccccgacagacgcaatgtccgcgcgaacgggcgaaccacgacggggacgcgccagaaaggggaccgaaaaccgcgcataaaaaacacgggccgccggaggacgcgacac

SEQ ID NO: 2556 - DNA, 1040 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaa

SEQ ID NO: 2557 - DNA, 2087 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaaaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggcttaaatatatggttttaaaattgacttaacttgagcaagatacattatgaagttctttctgattagagtgtgtggtctcaagacctttacagtagattatccttaagtgtccatagctctctggtacaatgtttagatatagtttatctatcaaaatagaacattcactataaagacctctcttccattccaatcatattatcccaacatgctaaatgttccaaacattttatttggaatgcattttatcatgtttttataggtttatttttctgattgtgttttatttaggctaatattaaaaaaatgcttactagtggtagaaggtggtgacaaagaaatactctgggtagcaggaggaagccaacttggattaaaattttgctgagaataatctaaaaattgttttgcagccaggtccatcatttggaaatcaggaaggcttgtgtctcatatatgagggaaaatcaacaaa

SEQ ID NO: 2558 - DNA, 1740 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggctta

SEQ ID NO: 2559 - DNA, 1637 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggctta

SEQ ID NO: 2560 - DNA, 1512 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggctta

SEQ ID NO: 2561 - DNA, 1778 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagttcttccttgagacactagaagcttgccaaagggccagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggctta

SEQ ID NO: 2562 - DNA, 1680 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacagtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggctta

SEQ ID NO: 2563 - DNA, 1550 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagttcttccttgagacactagaagcttgccaaagggccagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaaattttatgttgtgcacatttgcattgggtccaaatcctaattgcagtttagtgaaattactagatttttttctaatcttcagtatgtagtgagcattcacaggttttctcctagaatctcaagtggaattggaatcataaaaatgaatgagatttgaaaactttcacaaagattataaatgtagttagtttgatactccttagaataaaaaaatgaaacagtaacaacttttatgtaaaaaaattttacataagagttagcatctttagctttataatctaaggaaccaaatttaaaaaatgatggattatgctctgtgaaatgaaaagttcaatcattgcctaaaaaagatgatcaagttagttgatctcttgtacttggaaaagctacttttttcctaaagaacagagtggagtggatatattcactttttttttctaaaacatacaaagtgataaaataatcgtgcctaatgtcaaaactttactggtttgagaagaataatcaaaaaggacttataccaataggacttactattgttttttaaggatctcctctcacagtggtaatgaaacattaactgtaacagaaatttacaatttatgtgcttataaaattagttttatgaatgaacaataaactgatgcatataatggctta

SEQ ID NO: 2564 - DNA, 1033 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttaca

SEQ ID NO: 2565 - DNA, 1268 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagggtcctgacttgtcctgggcaagccaagtccattgcttctgctcctgggaagtgccaagattctgcagcgctgacttcaactgccttttcaggcctagactttgggctgctttccggatacctgcataagcaagcccttgttactgctacccatcctacctgcaccctgctttttccctcttgccacgctttttttcctctccctcttacccccaccctgtacaaaatgcataaaggatggaaaaactactgcagccagaagtctttgaatgaggcatcaatggatgaatatttaggcagcttagggctgtttcgaaagctgactgccaaggatgcctcttgcctctttcgggccatttcggagcagttgttttgcagccaggtccatcatttggaaatcaggaaggcttgtgtctcatatatgagggaaaatcaacaaa

SEQ ID NO: 2566 - DNA, 1071 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagttcttccttgagacactagaagcttgccaaagggccagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttaca

SEQ ID NO: 2567 - DNA, 1016 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtgcaggaagctgtttggagactctggaaaaaggaaagccactcgtagtggttataaacgaaaagttgatgaacaatcatcagctggaactggcaaagcagctacacaaagagggtcatctcttctattgtacctgcagttcttccttgagacactagaagcttgccaaagggccagcacgcttcctgggctgttacagtcaatggacttatcaacactgaaatgttatcctcctggccagccagaaaaattttctgcatttttggataaagttgttggattacaaaaataaacactaaactctcaacactttaaaagcaaccccca

SEQ ID NO: 2568 - DNA, 918 bp, Homo sapiens
tcaatgtttagggtatgatgttttttttttttacccatcagttttgaaaaagttaattacatttggcaattccccattcccttatagtgaggggtctcaagagctggctcctacacataaagggcttagaacagtggctggtacctaggccaccaatagtcttttgccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacagaaaatcgagagccttggttacaaccgacttatcctgcaaattggtagaggaacggtggtacctgaacccttcagtactgagtcgtttactctggatgtttacagtgcaggaagctgtttggagactctggaaaaaggaaagccactcgtagtggttataaacgaaaagttgatgaacaatcatcagctggaactggcaaagcagctacacaaagagggtcatctcttctattgtacctgcagcacgcttcctgggctgttacagtcaatggacttatcaacactgaaatgttatcctcctggccagccagaaaaattttctgcatttttggataaagttgttggattacaaaaataaacactaaactctcaacactttaaaagcaaccccca

SEQ ID NO: 2569 - DNA, 435 bp, Homo sapiens
ccccacccaaccggtgacacagcccggggccccgccgccccctggcggccattacggatttccgcctccctcacagaaggcagtcactgcaacgtgcgtggcctcagttgcgtcatatccggcccttgcgatcagggcttgaggaacccgcgccatgaagtgcgtgtttgttaccgtagggaccaccagctttgacgacctcattgcgtgtgtgtcggcgcccgacagtctgcaagtgagtgagggaggcgagcaggcggcggcttggctcgccacccgccatctccggccatactgccagccgcgttagccttgcctgaccgtcgcgctcggaaagaaacccccgcaactctaccacaggtgccgctgccccttagctggcttctgcccacgcccggcggggcccttctccggctacccggccactcggggttg

SEQ ID NO: 2570 - DNA, 938 bp, Homo sapiens
tcccaaagtgctgggattacaggcatgagccaccacacccagccaataattggttatattttcattttaggtaaatcatttattttccccagacctaggctggggggtagtatgtttgttctaatttaagcgattggtttaaataaatttccgatgtaatggttctatgtttaaaaccttatttccagcatacatggtggtgtggtatattgtttaattgtatatgaagttatgatagtaaattactggcaaagattatttcacagtcttcatgcatggtctagtagtttccccagcttattatcttgtctggcagctattacttttggtttcaatttttaaattctgttttcatgaatgaattgtgcttcagtttaaatatgcccagtcctgagaagtattacaaagccatgtgaagacatttttcatgaaatatcatttctgaaatatatcagttgacataggagataaggtatctgctgaatttatattgacattttatagtactctttgtattgctttaataatcctagtatgtatacttattaaaatatataaaaattcacatgtgcagtttttagaagtaccactatattcttggaagttagattcagtcatcagtgggcagcagatgaagtatggaattttctcccatgttacctaatatttttcttcttttgttttagcacgcttcctgggctgttacagtcaatggacttatcaacactgaaatgttatcctcctggccagccagaaaaattttctgcatttttggataaagttgttggattacaaaaataaacactaaactctcaacactttaaaagcaacccccaaattcaacctatgtaatgtgattaaatcaaattaaatacataatatatatttacaaaataatataattaataaacttcctacatctatagaatgtataggaa

SEQ ID NO: 2571 - DNA, 453 bp, Homo sapiens
ggatacatttgcattgttatatctgtgcatgaatgtataaaatggtatattaaagagaaataatttaagccagaaaaaaaattagttaatatttgttgtgaataaaattggaaagtaattaattattatttgcaggtattatctttgtttacttagataacaaaagaaactaaaagactaggctgggtgtggtggctcacgcctgtaatcccagcactttgggaggccgaggcaggtggatcacaaggtcaggagatcgagaccatcctggctaacacggtgaaaccccgtctctactaaaaatacgaaaaatagctgggcacctgtagtcccagctactggggaggtcgaggcaggagaatggcgtgaacccgggaggcggagcttgcagtagccgagatggcgccggcgcccctgcactcaagcctgggcaacacagcaagactccgtctc

SEQ ID NO: 2572 - DNA, 426 bp, Homo sapiens
tttttgttttattatgcatatgagtaaaagagatttgagttacatgaaaatctaatctctcatttcctgggagaaaaacaccagtatccttagaactaagaatattatggtgaacaatttagacaatatcttttctctaatgtttcttacattcttacgtcaggtggtgatgagggctgtggatcataaagaaataactgattatattaatgagataatccaaataatgataaagagctatgaagaaaataaaatgagataattgcagaaaatcagtggttggtgatggtagtattataaaacttgagatattgtgggccagaaggttttattgaggaggtaagatttgacataaaatgaataatgagaagttaaatgtgccaatgttttgtggaagagcattatagacagagaagtaaggtaaaa

SEQ ID NO: 2573 - DNA, 441 bp, Homo sapiens
gtagacggcaatcaatttgtcagacagatttcttagggtacgtgaggttggagaagtataagacctatggccaggaactcatcacatctgtgctgccctttccctgaagagtcagtagggtattgtagcataaaagtttaggaagtcttggctggacacagtggctcacacctgtaatcccagcactttgggccaaggtggacgaatcacttgagatcatgaattcaagaccaccctggccaacatggcaaaaccccgtctctactaaaaatattaaaaaaaaaattagctgggcatggtggtgctcacctgtagtcccagctactcgggaggctgaggcatgagaatcacttgaacccaggagggggaggttgcagtgagccgagattgccacactgcagcctggatgacagaataagactccgtttcaaaaaaaaaaag

SEQ ID NO: 2574 - DNA, 695 bp, Homo sapiens
taattccttgccaatcatacgctgctttttggtgtgtgtttcttttaattctgattactaacactttaagggatgctgccttcctgtggttacattttctgaactattttatgagattagttattcttgatttaggatataccatgggccagccatcaggctaaggagtttatattttatcaataattctcagaaaaaatttcctcaataatttgtgtcatttccatctcacaaatgaggatattgaggttctaaaaggtggtggtactgaaaactcgaaaatgtacctctgtttctcatttccaaaatctgaggttgcacctgtgtttctcatttccaaagcctgaggatgcacctctgttcctcgtctccaaagcccgaggtcccacttctgttcctcatctccaaagcctgaggttgcacctctgtttctcgtctccaaagcctgaggttgcctgcaagtctcttgaggattttttggtgtaaacaggttgagtttctggataggtgggcatattggcagctgaatatgtgggttttgagtgtgaaatacaggttcttagctatgacccagcaatcttctacttgttctgtgctcttccacataaattgctttttcttgattgtattttcataggagcaatttctgaggctggaaggcaggagcattgtaagagacatgtcagtggatgggg

SEQ ID NO: 2575 - DNA, 457 bp, Homo sapiens
caaccttgtgctttccccactcacagctctcattgcctgtaatcaaagtgcccagattaatgtctgtatcgtccctccagcggagatggcagtagttatctgccttatttcccctattcaacagcagctcagtgaacagttgtagggtaactgaaatgaatatgaaaatgtagattaggtgttagaaaaagagctaagaggatcctttataggagtgtttattttattttattttttgagacagggtctcactctgtcacccaggctggagtgcaatggcactatctcagctcactgcaacttccaccttcagggctcaagcaatcctcccacctcagcctcccaagcagctgactacaggcacacaccaccacggccggctattgttttgtatttttagtagagacaggggtcttgtcatattgcccaagctggtcttgaatgcctgaactccacc

SEQ ID NO: 2576 - DNA, 162 bp, Homo sapiens
caaaacaaatatttatcatattattagaaagctaatgtccctgtaaccagcactggggttgggaaatagagcataggtagtcaccccagaaatcccttcataagctttgtcctttctcttccttcaaaactagctgtcttcctcactcttatggcaatgacc

SEQ ID NO: 2577 - DNA, 331 bp, Homo sapiens
agtggttttggaatacaatcctcagtctgagccaaatctgtgataaaaatgcaaattcagacgttgcctctggatcacaaacctgaaatgtgatcaatctaaacctgttcttgtccatcaacaggagtttctatagcctgaaatcacaaaagtagaagcagaacatttcctaactttagaagtctgagaggcaagggtggcacgtaacagcctagggcaggctgccctttctgcccctccccatccacatcagtagcctcactccctctggctcccatcctcccgaggactcacagagctgtaaggcccacagttctgctctctatggaaa

SEQ ID NO: 2578 - DNA, 676 bp, Homo sapiens
  misc_feature (672)..(676): n is a, c, g, or t
aagaacaggggaggcctcgcgcggtggctcatgcctgtaatcacagcactttgggaggccaagacgggtggatcacctgaggtcaggagttcaacaccagcttggccaagatgatgaaaccccatctctactaaaaataccaaaattagccgggcgtgatagcgggcacctgtagtcccagctacttgggaggctgaggcagagaatcgcttgaatccgggaggcagaggttgcagtgagccaagattgcgccactgcactccagcctgggcgacagagcgagactccgtatcaaaaacaaacaaaaaacaggggaaacaggtgagaggcctgtcttggggattcattgtgattcctgcggcagttgcctccccagacacccagagcttgctggtcatcccagacccttgggcaagggcaagacagcagcgtccagcagtcggcttgtgcagggcagccttccaattgcccaaaatatgcgccctcccggacaccatccttggaagagaacctagttccttaccgatcctttcgtgcctcagtccacccagaccaattccagccttggtgaggcgtttccctctgaccaagcacccacccatgggaggcccgtgtcacccggctgcgtttcgcatctctgctcccatgaataaatgtatttactctaaaaannnnn

SEQ ID NO: 2579 - DNA, 1150 bp, Homo sapiens
ttaaaggtgcaataatgctgtttgaaatgaggagaacgcctgtgttttgtttgctgagagaaatccactatctctcatccagaagatgattagacccataatggaagccagtcagtggcatgaggaatcatggagatgattctcacctggttgattggatcagacgttcctagcccgaatgagggtggaaagggaaccaagagatgaagtggattgttgggtttatgagaggacggtggttgtctgtctatagttaaggttgtttaaactcatgaccatgagaatgagctttttctggataactctttccttttccttctgatttttgagagtgctgaaaactcaagtcctgtatttaaaaattccatcgttgaaaacatgtttcaaggacagatgacacacttatgattatagcatctgaagtgatgggaatattaaataacctttggttggacatgtaaccatcagggctccacttggtcttaaaaccaaacacacacagttcttgtcgttaaagatatccatggcctggcacagtggctcacgcctgtaatcctaacactttggaaagccgaggcgaggggttaacttgagcccaggggtttgagaccagcctgggcaacatggtgaaaccttgtctctacaaaaaatacaaaaattagctgggtgtggtgttgtgtgcctgtagtcccagctactagggaggctgaggcaggaaaatcacctgaacccaggaggtggaggttgcagtcaggcaccatcctgcgattgcactccagcctgggagacacagccagactccatctcacaaaaaaaaaaaaaaaaaaaaaaagacttacacagagaaagcctgaagcccacaagagcaattagcaaaaggaaccctgacataacaaatacggtggtgtgattagcaaccaggtagttaagctcaagggttgctatgtgtcataaacttgaaagctacattggccacgagtaacacaaatgtaggtgctaatcacagataggtggtgggcatttcaaactttctcttcatatctatggatacccttgcttgagtccaggagaacgagattagcgtgttcctcccttccttccttccttcctctatctctccctccctctctccgtgtcttcctccctccct

SEQ ID NO: 2580 - DNA, 262 bp, Homo sapiens
taaatcctttattgagcgccttctatgagccaagttctgttctggaagagaggattccagcagtgaacaaacagaagtctctgttcttacagagcttatattatgttgaacagaaataaataatgaacaaataagaatataataccaggtaaagagttctaggaagaacaaagcagggtaaaagcataagactaatgcctggcagatgtaatttacttagggtgaccaggaaaggccttactgagaagaaagcattagggca

SEQ ID NO: 2581 - DNA, 346 bp, Homo sapiens
tgagtcagagcctcactctgtcgctcaggctagagtgcagtggcatgatcttggctcactgcaacctccacctcacaggttcaagcaattctcctctctcagccacctgagtagctaggattaccagcacctgccaccatgcccagctaattttttgtatttttagaagagacggggtttcaccatgttggccaggctggtctcgaactcctgacctcaagtgatcctcccacctttgcctcccaaagtgctgggattacaggcatgagccactgtgcctggccagtactgggtcttgaccaaactaaaaatgaagactgtgttaattgtaaggtaattgtgattc

SEQ ID NO: 2582 - DNA, 485 bp, Homo sapiens
ttatgtctgcttattttacagttgaagtttgattctaaagtatgtacgattattcacaatatgtacaattatatataatcttagagaaattaatacaagccataccaagatatcagtgagacttactcatgccattacattctcatgacaggagcaagtcagtgtattttgtatattctgaatttccccggattaaagagttggagatactaaattctcttttagtaaaaggtttctcaatgaagttttctttcttaaaataccagggtaaagactttatagcactactagcttttttcctaagaaacaaaatgtaactaaaaactgcagactacatgagcatgacacaggatggcactctctgtttattacagttgccaagttgcatcataatgttgaatattgaaattggtttttcctaatttctctgaccacaagtataggtggggtttttcctctattgaagtagttccaaagtgactgag

SEQ ID NO: 2583 - DNA, 268 bp, Homo sapiens
aggattgttgttatttctgttttttcttattgttgtttgtttaatggcatttctaaacttattctgcaaggtctatattcattgtagtgtatagccattgaaatctgctcagtcagctttgtggtcagctaataattggatatagatatccttagatacctgaaaccagtaagtgttctagcctttgctaagaggttttgtgtacatattgggacatactgtcaatgcttaggcacaccatttacaacctcaacctctttttattttt

SEQ ID NO: 2584 - DNA, 455 bp, Homo sapiens
gcccggaatgtgtgatggtgggtgctccagatattctacacaagagaagggctcagggcaggagcagatgcttcaggcacccgggaagactgcggctggtggagacctggggataccgggttatttctgcctccacactgcaaggactctcatctcttatgagaaaggcaaatgacacccagctgaggctgggaagtgctgtaatgtgggtggggtgatggggctggctgccatgtccaggatcttcattggactgctgtgtggagagtctacccttcccttgccttactctgtgtgtgtgtttaagttcataacttattcttgcctgtggatctgggagagtgagggacaggggcggatggtatatttaattaaatatcgccactccctcctctttaaggtcattacagtcaataagggggagaagaaatatctctttaggaggcctttcaaat

SEQ ID NO: 2585 - DNA, 460 bp, Homo sapiens
aagtacctggctgtaaaaaatgtctccacggaaatggctacattctaggtgcacataacaacacttcagtcaacggcaggctgcatatacaaggtggtcccattagattacaataccatacttctaccataacttttctatgttaagatatgtttagatacacaaatacttaccattgtgttacaattgcctacagaattgagtagagtaacatgctgtacaggtccataacctaggagcaataggccataccagatagcctaggtgtgtaataagctataccatctaggcttgtgtaagtacactctacaacgttcgcacaactatgaaatcgcctaacatgtttctcagaagatatccccaccactaagtgatgcatgactgtataagtattatatgccacaatacccagaagctacatgcaaaccccagtgttaaagatggagaagaacatgattac

SEQ ID NO: 2586 - DNA, 436 bp, Homo sapiens
tttaaagaggaaaagtgcaataaaataaatagtgactgttttctttagcaatagctctttcaaaatcttgctctcaggactgaaaagtgatagatagtacctggattatcagataatgcccttgacttctgggggctcattcacagtctctgtagtttcttcttcttcccacgtgttcacatgactcctgtcctcttgagatctgacctccttctggaatggacacatatgctaagatgcagtgtatgcacaaggaaggcctgtgagagggctttgtcactttgtctccttcctgtgtgcacctctctgtctccatgtgtgtctctgtcccctctccctctgtctccccatttctgcctgctgtcatacagcatccttacaacctctaggcatgaaaatcctaagtttgtgtgaccttttcagcccattttgttga

SEQ ID NO: 2587 - DNA, 341 bp, Homo sapiens
ggaagcaagcatgttttaaccatggtagagcatgagtgggatgggggaggtgccacacacttttaaatgatcagatcttgtgagacctcccctgatttgggtggggacacagagccaaaagatatcattctgccccagcccctcccaaatctcatgtccttctcacatttcaaaacaaatcatgcctatccaacagtccctcaatgtcttaactcattccagtattaactcaaaagtccaagtccaaagtctcagcagacacaaggtgatataatttggctctgtccccacctgaatctcatttttgaattgtaatccgaattgtaattcccatgggtcag

SEQ ID NO: 2588 - DNA, 423 bp, Homo sapiens
ttttgaatagtcactctgcaattggggagggtcgcaagattaccttgttcaacaatttgttagaagaactcacagaatgtggcaaagctggtatcctcaccatcacagtttattatagcgaaatgataccgattaaaatcagcaacaagaaagaaaaggtgcttagggtaggatctctgggagcctgggtgtagaacttccagttctctcccagtgggtcacgcagagtgggctcattcctcgcagcaaaaacctgcgatcgcatgcacagagtactgctaactggggaaacccctctggagcttggcatgcagaattcctacgaagggttgctcccacggtcagggcttgaccacctgcaaggctgaccttcaaccttttaggctccttcccaggagatgagtcaatgttgggtggatcaag

SEQ ID NO: 2589 - DNA, 1173 bp, Homo sapiens
agtaacaacgctcaaattatcagaaactgtaaaaatttccagtttttactggaaataaaaactgtgctgggtgcagtgtctcaggcctgtaatcccagcaattttggtggccgaggcaggtgtatcacttgagctcaggagctcgagaccagcctgggaagcatggtgaaaccctgtctctaccagaaatacaagaaattagctgggcatggcagctcaagcctgtggtctcagctactcgggaggcggaggtggaaggatcacttgagcccaggacgcggagattgcaatgagcctagatcccgccactgcactccaggctgggtgacagagtgaaaccctgtctctaaaaataataataataattaaaggtaccaaaaataaataattgatggtaatgctgacccaaattaaatttaaccttcaaattacttatgaaaaatgtagtatatcataagaaagtcaatagtaagaaatttcatgttaagacagtgttttcatatattttaacattttacatataaatagtatgctaattgcaaattcattttatttaatgtttaatagtttatgttatgaattcaaggcattttctatacttgtcaataatgaaaaggcatttctccttttaaaaattctatgaagtcagccttcttattccttaggaacatgaactagtgtggtttggttttgaatctgattgttcaaacactttacaaagtgaataggaaaataatttgggaacatttatatttaaacttgtcaatctatgattctgtttttcatgtgacagccaatcacaatgtgttctctactcaggaagtttagctcagtatatggattaacacgtgttctacttgtgtgatatttcttatgacaaccacagaaaacatatggggctgggcacagtggcttatgcctgtaatcccagaactttgggaggccaaggcgggtggatcacttgagcgcagtaatttgacaccagcctgggcagcatgtcgaaactgcgtctctacaaaaaataccaaaattaaccaggtgtggcggcacatgcctgtaatcctagcttctcgagaagctgaggtgggaggattacctgagccggggaggtcaaggttgcggtgagccgtgatagtgccactgcactcaagcctgggtgacagagtgagaccc

SEQ ID NO: 2590 - DNA, 165 bp, Homo sapiens
caaaaagattgcttgaggctaggcattcaagattacagtgaggtgctgggtgcagtgtctcaggcctgtaatcccagcaattttggtggccgaggcaggtgtatcacttgagctcaggagctcgagaccagcctgggaagcatggtgaaaccctgtctctaccag

SEQ ID NO: 2591 - DNA, 938 bp, Homo sapiens
cacacacatacacacaatgacaacaacaacaacaaacccaacccgttggatatcttatcagcagccctattgctatataaaaatttttagctgctactgaccaatcaatataaacctgataatcaagccagaagttctccaaatatgttagaggaaatctaattctaatcttaaaccactaatctccctttcagcacatgaaatgtacatgtaatgcacatacagcaaatgataggttaacagtagaacttggttatatataataatggctatttcaggacactgtgaagttctgcttgctaagattcaattcaagatgaaagatcacataggtattgtaacatgcaaccctggatagcgaggtagtttaaaaataggtagtctacttcaaacttggaagaagtactgattgaagctgtgaggaatggcctttgtctccatttctgatttgtcggaatgatctgtcttaaaggctgcaggtaccttatgctacctcagacctatgaaggtaggacctatgttaaaagaaaggagaataattgctgtccaagtagtcataattttagaattatgtagaatttgacatggacctgtgttttcagatcatgcctggtgccagcatttccagttgccttcttcccagaactgaggctgtccatgacccatcagtagtcccttcccagtcctgtagtcattctcaaccttggttgcacaatgaaatcaccttgggcactggaaaaataccaacgtccagacccacacccagagattctgatctaattaaatggggaggggatccaggcatcagtgattctaatgtgcagtcagggttgaaagtctctgctctagagactgcttgtacctcaggcaggagagatttcaggagattgaggtgaatgctcttcagctcagcgatgccatcgctgttgttgtctggc

SEQ ID NO: 2592 - DNA, 454 bp, Homo sapiens
attcacttttatagtcataatttcataattgtctgctttattggtgggggcatatgaaagaagtatatcaaccactatgggtataaaatagcttcttaatctttgttctggatagtcacctttcttattcattgagatgagtcatatttccatattaaaatgtatcattttggctgagcacagtggctcctgcctgtaatcccagcactttgggaggctgaagtgggaggatcgcttgagtccaggaattcaacaccagccagggcaaaatagcaaaaccccatctctacaaaaaatactaaaatcagctgggtgtggtgacaggcacctatagttcaagctacttgggaggctgaggtgggaggattgtttgagcctgggaggtggagtttgctgtgagccaagattgagccacagtgtactacatcgtaggtgaaagagtgagacccagtct

SEQ ID NO: 2593 - DNA, 374 bp, Homo sapiens
cctttgtgacaccctttctctggctttgggtgttgtcttcccagtttcctgaagagaaagaatgtgtaggccgggtgcagtggctcatgcctataatcccagcactttgggaggccgagttgggcggatcacctgaggtctggagttcgagaccagcctggccaacatggtgaaaccccgtctctactaaaatacaaaaattagctgggtgtggtggcaggcgcctgtaatcccacctacatgggagcctgaggcaggagaatcacttgaacccgggaggcggcgattggagtgagctgagaccacaccatggcactccagcctgggtgacaagagcgagactccatctcaaaaaaaaaaaaaaaaaaaagaga

SEQ ID NO: 2594 - DNA, 417 bp, Homo sapiens
taaaatgcccttgtcagaaaacacagagatcccagttcagatgtgccccctcaggaccagcaaatctaaggcagtgcctaccagtcttgatttcttgcgtttcactctgtcacatcctggtctttatagtacttactactgtctgagattacattggtcagctatttatttacttgtatgtttactgactccttttattctagactgtaatttccaattatattgcccctcttattgttgtagctcaaatttttagaactgtgcttggcatttaaaaggtactcaattaaagttgaataaacgaatgattccttaaccatttgttgataaagtccttcctatttagtctttcatttgatgacttcatttgatgccattcaagttagagcagttattagccacattttacacatccca

SEQ ID NO: 2595 - DNA, 490 bp, Homo sapiens
tcccatgtagaaatggtaacttggagtcaaacagactgaagatttttttttaattaatcaggaaaaatgatctatgtgtgaacctttactataagttattcttacttctagtatgttgtgatttagaacagtagtaagaagaaaaatactgcagaaataaagcactaattcttttcagagccaaacacagtttgaagcctacagaagctcctagaccaagtaaaataggttctatagaaataataaattctataccctgtagaaagaataacttttaaacccttgtagagtgaatagaaaaaaaaccaaatccattgaaaatttgtagaaaatataaaactccataattgtaggaaatataaatatcagaaaagctgcataaaagtggtcgcatattattgtgacttctggcatatgtagatgcagccaaataacttgacattttgatgtaaaattaaaatgctcccttgtccatcccccaactccctgc

SEQ ID NO: 2596 - DNA, 275 bp, Homo sapiens
aaaaagccatgtatcaaaacgattagattaaagaaaaaaaattggcctggctcggtggctcatgcctgtaatcctgaggcaggaggattgcttgagcctaggagtttgaggccagcctgggcaacatagcaagaccccatttctagttaaaaaagacagctggcctggggcagtggctcatgcttgtaatcccagcaatttgggaggccgaggcaggcagatcacgaagtcaggagttcgagaccaacctggtcaacatggtccctgtctctact

SEQ ID NO: 2597 - DNA, 358 bp, Homo sapiens
ggaaaacgattacctttatctcattatcttagttctctttggaagatatataagcttgaaccatggtgacaggtgttgcctttaaacatggtgacaggtgttttcctttaaagtccttggcaaatcaactcatagacttcttcaacttcaaaaaaaaagtttttttaaaaaatattttaaaaatatttaacttgaggatcttcattgaaaattggtcatctttcgtgaatttgcttaagtaggctttgatctctttttaaaggattccttcctgcctgatacatttggtccttttagaattcgggctagaacaattctccatgaaggtggacgtgttaaaatctatttggttcattgt

SEQ ID NO: 2598 - DNA, 580 bp, Homo sapiens
aaaaaatgtataaagcagctggaaatgttttaaatacaaggtctttgaattaaatgtggattttaaaaatatgtaatccccctgacaaaaggacccaaaattatggtgaaactaatgcctccccctgcgttcctttgaatcattaccctatgacttaacaaatctgcccctggagatgtggacattcctgcatttgccttctgtatctggagagatgtttgtatatatcccaggccgtatacacacacatttccatatctctctacagatatatttccccttcaatcgtgacctggtatttggaactctccttttcatttggcttatcttccttttaatgtgatgtctctgtgctaatacttaccagttcttgttttgcaatctgttttgaggtccattgctttactaagacccactgcatcttggctgatttcaaagtgacacctgaatacagtgtttaaaaaaaaaaaagttttgtttgtaaatcatgtgaccagcttctctcaacctgacatggaaagtctcttgtactacagtgtatttaataaaaatgatgtcttacaataaataacatactcca

SEQ ID NO: 2599 - DNA, 529 bp, Homo sapiens
cttgcaataattcgacatgggccgcttctgtctgtgggtctcagtgcaaacctgccaccatgagatgagctaaaaagcaagcttgcaaaatgaagttcctgaggagtgtgatctctagggccctagttgaggtactcttactacagccaggctgaaagcatatttcagcttgtagcaagctggtttcgtctctacctgaggaaagataaagaactttgctcaggaaatgtgagcccctgttcccaggcttcattcctctcaagctgatggacaggtatggaaggaatgcgttcgttggcaggaattagataatgcccaggcacaaatggcagtcacgttcttttcctccctctctctgctttgggggaaaaatgtggtaggaggggatgctctgcagggagaggggtgcagaacaagctgtctcagcttcagccagctgccgtttgtcactggattctgacaatggcatctggctccgtgagtgtggaagccagggacctccctcacggtgaaggccgagtgaccagtg

SEQ ID NO: 2600 - DNA, 352 bp, Homo sapiens
aaagacaatgcaatgcagagataatccagaagtataagctagataggacatccactaatctttttttcgttctcttttcaaagtatttcacagattttcctgagtacttttactgttattccccttttacaggtgaggaaattgttaagtaaattttccaaggtcccataaccagtaagtggtagagacatatgtgaacacaagtctaactgaatctgaaaaaataattcagtttattgaatcagttttcctcttggaggtggagcttgcagtgagccgagatcgcaccactgcactccaacctgggcggcagagcgagactctgtgtcaaaaaaaaaaacaaacaaacaaa

SEQ ID NO: 2601 - DNA, 226 bp, Homo sapiens
ctgagggtggatcttctggctcagtacccacagttcctccccgtttcccagctgattaggttccagagtcactctccggtctgtgcactcgctggggaaaagctcaaattggtcaacattttcttgaaacagggtacctgacctcatcccagacctctgggacagttgtaaaagtagtggcatttctaagaactcaaaggggttaactgtaagacgaaaacaactt

SEQ ID NO: 2602 - DNA, 429 bp, Homo sapiens
tcttacagaacagtttcccaagcagcagcctgcctgatccacccttaattcagctgtgcgtctgacaacatgttctacaggaaagataaccttgtacatcaggtgtttcctgtttccagtaccaaaagtgtcttcctttggctttggtatcaaggtaatgctggcctcataagttgtctccctttatccatgagggacatcttccaaggcccccagtggatgtctgaaaccgcagcatacttttgtccataaagcaaaatccgaagattagtgttaagaaacaggatttggaactctcagaacaaggccattgggggtggagatttcttacctatggcttaaagaggcttccgaggtgatcgggcagcatcagtcttcagctgctaagccgagaagatctgggaaggagtcagtcagagagccgtgggc

SEQ ID NO: 2603 - DNA, 469 bp, Homo sapiens
cttcttgctttgcacagtcatgtgaggaggtaaggcccagagctgtggtggccatcttgtgactgagatggacacattggtggataaaagccaatccactgagggcgagaagtaggggaacacctttgaaacatcaaaacaacctcaggactgcccactgccatgttgtctttttaagtgaactataaattccttatggctcattccactgttactcaaattgtctcttatttggagctcaatgcaccctaagtgataaaacaaacataaggtcctcagaaggaacagaacagagacaaggcacagaaaactggagttcagatgcagcctcccggatactaaagatccacccattcttcccagcgaagagcaaccttacattgctgtttgaactccagtgcatggcagcatatcactaagcatcttcctgaggagttactatatggtgatatgcctagagcactcactc

SEQ ID NO: 2604 - DNA, 451 bp, Homo sapiens
gtgtcctattaatttctgaggtcctgaaagaaccacacttattcttaggagagatgtctgatcttgaagttactgaagaacccccaattttatccaggtatcgaggacctctctgaaggactctgagcagaatttaacattcaggagtgatttctttaaattttaattttatttaagaaatttggctcttcctattctccatgatggtgcaggatcaaggtgaaaagaagatccccacttgggaacttcacatccacaaactcgcctcaatatctgtgtggggagggtagagacagactgacctgagcagctcacaggccagacccctgtgttttccaaagccaagtacagcatcagatccttcagcatcaggagaaatgaagagattgccgtccactgcacactctgaggggccaaggcagaaacaatcctggagaaaggtctaaaggta

SEQ ID NO: 2605 - DNA, 421 bp, Homo sapiens
gatcacttgagctcaggagattgagaccggcctgggcaacatggcgaaaccccatctctaccaaaaatacaaaaaaatcagccaggcgtggtggcgggcacatgtggtcccagctacttgggatgctgagatggtaggatcgcttaagcccaggagatggaggttgcagtgagctgagatcacaccactgcactccagcctgggtgacagagtaagactctgtctcaaaaaaaaaaaaaaaaaaagaaagagaaaaagaagtaaagcatggattcagagtttgagcaggcgaggaagaggaagagaaagagaatcagacccatatctgccttcctcttggttttcacctcagccgtcaacaggtttgttggtctttgttgaaccagcaaaggagcggagtggggctgagggaaatctggtg

SEQ ID NO: 2606 - DNA, 356 bp, Homo sapiens
gatgcccatcctgtctgggcaagtctggggagacctcccccaggagagcaggatgcttgaatgggctctcaaggcctgacattggtggctcatgcctataatcccagcactttgggaggcagaggcaggcagatcacttgaggccaagggttcaaaaccagcctggccaacatggtgaaaccccgtctctactaaaaatacaaaaagattagctgggcgtggtggcaggcacctgtagtcccagctactcgggagggtgaggcaggagaatcgcctgagcctgggaggtggaggttgcagtgagcagagatcatgtcactgcactgcagcctgggagacagagacctgtctcaaat

SEQ ID NO: 2607 - DNA, 2040 bp, Homo sapiens
gctttgttccacaatattatatggaccactgaacaagaatgacagccctttgttatcacttggcatatgaaaagtgttgtgtgcatagtttgtgttaattttttatgtgcataaaaatgtgattttaatttatatgctctgaaggataattcagggtatagttaaaaatgtacaatgtgccagttcagtatatataaccctagccctcaaattattctgattaaggttaaaatgtgctggtattacgtgctttttcctgaggccttctgattggttcttggtaacagaattttaaagtaaggtgtgagtagtgcaactcctgtcctttatatataaagatatcaagtaatttcatgtcctgatatttaaaaaaattacccacaaatgtgtttttttaaatcgatcaaagctagcaacaggttaaattgtctcagttctcttacataattgggttaaaaattataaggtattagaagaattttaattaatgccaaattggtaaatatggtgtaaaaaaaaaaaaaaagacttttcattttctcccacatagaatagtcagatatattaaacatcccttttccataaagatggtttcaatgggaatggaagaaacaaaatcttaaaagagtgagtatagctgaaccaattcttcattctagcaataaccacactaagttcattactttacaaatgactaaacccaatgtcttgtcctttaaaaaatataggtagtgcagaattgtgataaatacgcatttgtttttttagagagccccactccccaaagggtagccattaattcaggtagccttttaaatgtatttgagagggttccgtctttttggctgctatcctagttaggtgagatgttgctatgggaagaacttgccactatacactaaacagacactttaagcaaaagatgtattctggagcctggcacagtagcttatgtctttggttctagctactcaggagcctgaggtgggagcatcatttgaactcagttctgggccactgagaccctctttaaagagaaggaaaaaaaggtattctggaagatcttgtgcagttgcaacaatgtttcagcatatatatgtgaattcatatatgacacctgaacggaatcatgaagtaacagctgagattatatggtggcaaaaatgacctgcttttcctgaagctttgggaggcctaggattcttgctttaggcatcacctttgttaagccttaaagggggctacaacttgtgcaaaatggtgtctctggtaacacttcagaaataattggcaaaagtgtaataggaatacacaaatctttattttgaaataatcttgtattttaatgtggaattagaagcagcacatcaaactggtgagttcacagaaacttacctgagatgatgctgggttccattgctgttgtgctaagtcacgtatttttgtagctgctgttagctgtgtctagcgttttgtaacctaaggagggtcttatagaagttggtatgttaactaaatcttggactgggaaacagcaccatttgtatcctctgcaaacagatttacgcttttgaggctcaaaccaactagtgttctcatgggctgttgcctaaggacagataaacatggaaaacaggctatgtccagggacagatgattggtggttaagaattacagtaaaggaaaattacacctggattttcttctgtaaagtttcaaggaacttggatttgaactgtgaatctactgttttggcaaaaaatctcaaagaaaaggatgtttgttactgtctcagtcttcctgtctttgctacacgatttggatcccttacgctttttcgttaagaatatctgtctgctatagtgaatttgctagccccttatttttttttttaattttagttctttattagaacgtgtacttgaatggactgtagttgctcataacccatgttaatctctgatagtatttgggttttatttcaggagcttttgcaataaagcagtaactgcaatctgctaaagtcagactgttagcaag

SEQ ID NO: 2608 - DNA, 586 bp, Homo sapiens
gccacttttgagctggtagtttctgacactggtacaccacagggttgaggagatgaggctaatagcaggagagtggttgacatgatgggaaatggagtctaattaatagaaaagagagtgaagatagatgggactgaaagactacaagaaaagggcctgggagaagggaacaaagaattattggactcaggaagaatggcggaagaggagattaattcccttattgggggttacccaagataaaaagcatctttttctcaaaaattcatatattttaaagagaactttctgatactagaaagtaatattgccctgggctcgcccctgtaatcttagcaccttgggaggctgaggcgggcagatcgcctgagctcagggcttcaagatgagcctggccaacatggtgaaaacccgtatctactaaaatacaaaaatttccctaggcatggtggcacgtgcctataatcctagctactcaggaggctgaggcgtgggaattgctggagtccgggaggtggaggttgcagtgaactgacattgcaccactgcactccagcctgggcgacagagtgagactccatctcaa

SEQ ID NO: 2609 - DNA, 447 bp, Homo sapiens
tccatcaggaatttcctgagcaggggcagcctttttcttcctccactcagctttctccaggtagatgggacaaagcccaagacaagcgctgcctccatcacaggaatagtctggggcctggcccagccaagtctatgggccatgcatttttcctgtattttaccctcggtggctggagcgtgtggcgggatgaggaggttggcaggcttgcctcagtgccccaactgggggccttgcccagctgagctccgtttggccagaggccagctgggaaacacttgattattcaaatcatgtggccgcccaagaggaaagcatccgtttcctccaagagggggaagtggggcaggcaggccagcccagggatttggttgttgaaaagggaaatttcagaacaaagttctcacacaaaccagcactctgagattcactgccccaggaagactc

SEQ ID NO: 2610 - DNA, 421 bp, Homo sapiens
ttattaagatatatacttagcactttgaattgcttcaaacataatttgaggggaacaaagacttattggcttgttggttttaagaactgaatttgcctaggcattagaaaaagtacagaaagctccccagagcagtctagagcccagcagtcgcaggcccctaggccatttgagttataggacagaaggtgggggtgtcagtgaacactattccttctgagtgtctgtcaatggaggttgcatgtgaaacaggaaagaggtttgctgaggctctatgtttatgtttgccttttcttcaactggagactgaagtttgagaatagcaagtaagcacgtaatcattctcctagatctcattacttgagatcttttttttttttttttttgagacagggtctggctctgttgcccaggctggagt

SEQ ID NO: 2611 - DNA, 303 bp, Homo sapiens
gaatggggtgtgtgtgtgtgtgtgtgtgtgtgtgtgtgttttctcggctgctgaagagactgagtgttcctgcagatatataacaaagatgaagatgtgccaccgttggagacaaatggggaccagaggccacatgtcagaggtcaggtcaggtgttcaaatataaaggggttccctggctgggcatggtggctcacatccataatccaagccctttgtggggctgaggccggaggatcacttgagcccaagagttcaagaccagcctggacaacatagcaaagccccatctctaaaaaaaaa

SEQ ID NO: 2612 - DNA, 496 bp, Homo sapiens
tctgtatctccagctaccatttagtcagtcacagacctccatgccggtgtagacacacaaggtggcagagagggaaaggcagtataacatacaggttaagcacatgctctggagccagatttcctggatttagatcttagctcttttatttccagctatgtaactttgagtaagtttcctaacctctatttctctcagtttccttaaccgtaaaatgataataatcatacatactcacaaggttgtcgtaagaattcagccagaaaataactggaaagtactgagacgagcctgccagtaaatgttagccatcatgttcagtaatggccttgcaaaacagattaccccttcaccttctcacttaattgtctacctatgaatcattaatgttttgttttgtttttaattctgtgataggtaggaaaggatggaactccttggcagactagtgttagaaagttttcgaagcagtgtgagtcttgtacctttgtggtcc

SEQ ID NO: 2613 - DNA, 411 bp, Homo sapiens
atggagatagcttctttggctaaacttccatgaaccaacctctgttagcttcccaacttttccttctgtagcttccttacctcactcagccttcacgtaattgaagagagttagggccttactctggattaggctttggcttaagggactgttgtaactggtttgatcttcagtgatgttcccagatcactgaaactttctctacatcagccataaggcccttttactttcttactattcatatgtttactggagtcacccttaaaaaaatttttttaagcttttcctttgcattcacagcatgcttaatgggcacctgaggcctagttttggcctctctctgatttcaacatgacttcctttctaagctcaatcatttctagctttcaactgaaagtttaaaaaaaaaaa

SEQ ID NO: 2614 - DNA, 517 bp, Homo sapiens
ttactgatgtatgatgccatttttaccctcagtttggtaacagctggatgtacacatgtatactagttctagttaggcaccgagatatttgtcagctgttttctttgaaactaggtttctttcaatatggcccattggctaaggccaagtaatatagtccagtctatttctctaagctgagtgaactgctttctatattctttccagtcttctgccaggtcccctttttcctgccatctgtcacaatgagagagattgataggaaaagagtttttgtgattaaaattcaaaacgaatacagatttccattgcttattataattagaagtacagtgatatctaaccatgtaacgacattatatacctcaccccactctcatactccaacaagaagatgaaaacccagacatgttactagttaataactcagcataatatgagttataataatgtacacagtgcttacaacttaaatgtgaactagaactttttttcctataatttgctttcaacttat

SEQ ID NO: 2615 - DNA, 298 bp, Homo sapiens
cgagaacatattctttagtttacaaaaggccaggaaaatctcaacttgcctgggaaaagaaaatcaacagatgtcagtgctgacatgacacagacaatggaattatctgacaaaggctttaaagcggctgctattttttaaaatgctccagtaagtaagggcaaacattactgaaacaactggaaagatgtttcagcaaagaaatagaagatataatgaagaagcaagtgaaaactagaactgaaaaaatacaataactgaaaaaaagaacctcactgaatgatctcagtaatagaat

SEQ ID NO: 2616 - DNA, 411 bp, Homo sapiens
ctgagaatgtaataacatgtaactatttaggggtccaaacccatttcaggaaaatagtaattgaggagaaaaatagatcacgtttttctatccttggagaagctgagaaaagaaagttatctcctggtggggtactaggtagagtgggctgaataacagatactccctgccacaaaaatcacatcctcatcttcaacaccgtgaatatgttactttacttggtaaaagggactttgcagatgtgattaggttaaggttgagacgggggattgccctggattatctgagtagatccaaaagagagaggcaggagagccacaggtggaaagagatgtggtggtagaagtagaggtgagagagagagaaagagagagatccaaagatgctatgctgctggttctgaagatgaac

SEQ ID NO: 2617 - DNA, 383 bp, Homo sapiens
ctaaatattaatgagtaagtagttgcatggagtgtcatgatggctgacagctgtagatggaggtgtttttagtggtctgaaactgtatactggtcacccatttctatttttttttttttagttttttgagacagagtcctgctctgtcgcccaagtagctgggactacaggcacgcgccaccatacccagctaatttttgtatttttagtagagacggggtttcaccatattggccaggatagtctcgatctcttgacctcgtgattggctggaatgcagtggggtgatttcagctcagtgcagcctctgtctcctgggttcaagcaattctcctgcctcagcctcccgagtagctgggattacaggcacccgccacgaggcc

SEQ ID NO: 2618 - DNA, 312 bp, Homo sapiens
aactcttctaccagccacactgatgagacccttaggatgagggtgcaggaggtggacagtggaccaaatcagagagcactgccataccatctccctgaacctgaacccccatggaccactggaccatgagctcaggcatcagaatgagtgagggccaggaccagaaaaatggccctggcaggcccacctacacccacgtttggacagcatggtgtccctctttaagtcacgtctcaaatgggctctgctttcaatctggtgctgttcacgagtcctgtggcctctccagtccagactgctcctcgatgaaat

SEQ ID NO: 2619 - DNA, 535 bp, Homo sapiens
atactcagaaattgataatctgaaagtagtaatttgtagactatgaaaccatagaaaataatcttctggtttaaaaaaaattagagggttgtttgaaaaataacatgaattttgcatataaaaaaactgaaaggttttgcaaaatacagtatttagcggtcacaaacagtgcaggaaaataagaagtctacgagctttaagaaatgtagaagattacttggaaagacatagtatgtttgtagatgataagactgagcattataacgtgtcagtctttctcgactacgtttcttgaaagcagttttccaggtaattttttagtgttcatttggaagaatgaaaggtaaatagtgaaatgccatttgacaaaaatgaacaagaaatgttaatgcccaaatcttagggagagtttaagacaggcagtcttgtattactaccgtttttgtgtaaattgatttatattttgagacaagcaaatttagaaatatttatcgagtcaaaaattactcatagtagaattcctaagtaggccaat

SEQ ID NO: 2620 - DNA, 394 bp, Homo sapiens
ccatcgttaggagggttggacctgcactctaggatttggagagttgggagcacattctaactctcagggaaacatggggctgtgtctgtgaaaagccactaaaggaccgggcgcggtagctcaagcctataattccagcactttggcaggccgaggcaggcagatcacttgaggtcaggagttcaagaccagcctggccaacgtggtgaaatcctgtatctactaaaaatacaaaaattagccgggtgtggtggtggacacctgtaatccaggctacttgggaggctgaggcagaagaattgcttaaacccaggagatggagactgcagtgagccaagattgcaccactgcactccagcctgggcgataagcgagactctgtctcaaaaaaaaa

SEQ ID NO: 2621 - DNA, 381 bp, Homo sapiens
aggctacatactgccaacaaccatgtgtctctctagtccacctcctgcccctgagctccggactcacatccgattgcctctttaatctctccgtttgaatgcccaacaggcatctcaaaaacacttcccccatggcctcccagtttcccccatggtaagaaacagcccaccggctactctgttcgagtcacactctcagacagatttctcctttctgtccatcatctcttccccacctctgtctctaaagtatatcacagcttcgtgccccagcacctagcacagcacatggcaagcttcccgtaaatgtgtgctgagtcacctctggaggtcacctgctaatgagggaggtctctcctggcacaggtcacttaggaaagg

SEQ ID NO: 2622 - DNA, 294 bp, Homo sapiens
taggcataactaacttttctcaaataaagtgtgaaagaaagtatttttaaaatttcatctcttaaccagatgttttaagaatatatccctaggccgggtgcagtggctcacacctgtaatcccagcactttgggaggccgaggtggggggaccacctgaggttgggagttcgagactagcctgaccaatatggagaaaccccatctctattaaaaatacaaaatttttaaaaaaaatacaaaattagccaggcgtggtggcacatgcctgtaatcccagctactcaggaggctg

SEQ ID NO: 2623 - DNA, 437 bp, Homo sapiens
aatgtagcttactcatagtctgtgcagtgtgaagtgtggccaaagctggtttgggggtcaggtgatctgggttagaatcctaccactgccattacaaactgtgagaatttgtagaactcactgaatccttttgaccttattttcttcatctataaattgagcaagtaacactatgatttagagttttttgggtttttttgagacagggtcttgctccgtcccacccaggctggagtgcagtggtgcgatcatgactcactgcagccttgagacttcctgggctcaagtgatccccctgcctcagtctcctgggtgactaggactagaggcacacccaccatgactagctagttgtagagattttaaattacacaaagcaagcaaaaggttgagcttattgcctggcatgtagtaggtacttgaaaaattgttagctc

SEQ ID NO: 2624 - DNA, 1428 bp, Homo sapiens
  misc_feature (8)..(8): n is a, c, g, or t
  misc_feature (10)..(10): n is a, c, g, or t
  misc_feature (12)..(12): n is a, c, g, or t
ccgaattngncnttggccgggcgatttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaaacagctagaggagtttattgtgatggaatgcagcatagtccaagatataaaacgtgctgcaggtgctggaatgatatcaaaaaagcataccctcggggaagtctgggtacagaagacatctgaaatgaatacagataaacagtatttttgtcgtactcatttgggacatcttctaaatcctggagagctggtgttagggtttgatttggccaactgtaacttaaatgatgagcatggcaacaaaatgaactcagatagagttccagatgtggtattaatcaagaagaactaagactggaccaaacgtcagcgtcgtagaaactggaaattgaaagagcttgcaagagagagagaaaacatggatacagatgatgaaaggcaataccaagattttcttgaagatcttgaagaagatgaggcaattcgaaaaaatgtcaacatttacagagattcagccatccctgtggaaagtgacaccgatgatgaaggagcacctcgaattagtctggctgagatgcttgaagaccttcatatttcccaagatgccactggtgaagaaggtgcatcaatgctgacataatgagatgttgtagactgtttccacatatgtgggcttaagaagttgg

SEQ ID NO: 2625 - DNA, 959 bp, Homo sapiens
gtctggaggtgtgaagcatacagaacaatggagtatatgacagaatcgactgaccgcagccctggactcatcctgtgctgtgagtgtggtattgcaataagtcccaatcctgccaatatttgtgtggcctgtttgcaaagtaaagtgggcatcagccaagatattccaaaacaagtctcactttcgttctgcaaacaatgtcaaaggtattttcaaccaccaggaacttggatacagtgtgctttagaatccagggaacttcttgctttgtgcttgaaaaaaatcaaagcccctctgagtaaggtacggcttgtagatgcaggctttgtttggactgagcctcattctaagagacttaaagttaaactgactattcagaaagaggtgatgaatggtgctatccttcaacaagtgtttgtggtggattatgttgttcagtcccaaatgtgtggagattgccatagagtagaagctaaggatttctggaaggctgtgattcaagtgaggcaaaagactttgcataaaaaaactttctactatctggaacagttaattctgaaatatggaatgcatcagaatacacttcgtatcaaagagattcatgatggtctggatttttattattcctcaaaacaacatgctcagaagatggtcgaatttcttcagtgtacagttccctgtagatacaaagcatcacaaagactgatctctcaagatatccatagtaacacatacaattacaaaagcactttttctgtggaaattgttccaatatgcaaggataatgttgtctgtctgtctccaaaactggcacaaagcctgggaaatatgaaccagatttgtgtgtgtattcgagtaaccagtgccattcacctcattgatccaaacaccctacaagtggcagatattgatgggagcactttctggagtcaccctttcaatagtttatgtcatcccaa

SEQ ID NO: 2626 - DNA, 318 bp, Homo sapiens
ccgcttccaggtcacttccctcacctggaactcccacctgctcttccagcccttgttcatcccagctcctgctggaccatcgcccccttccagcctcttctcggaccttccacctggcttaggctgagaccctctctttctgcccctcggcaacactgtgcgcattggggcgcgatgccccgcgtctgcctgaaatagctgcccgagtccccgggagcccagcccagcctcagctctcggcgggctccggggctgcctgcactcaattagagacaactctgtcggcccaaaggagaccctggcaggaacgaagtatcc

SEQ ID NO: 2627 - DNA, 458 bp, Homo sapiens
agcaatcctctcacctcagcctgccaaagttctgcgattataggtgcgagccaccacacctggccacaggcacatattatttttcttgtgtttcttcaggatgattttaaatgatagggtctccctcatgttctggttttcccatctgcacttgggaaatagttggctaagtttagcttcatttgaataactcaaacatgtgctacattgttccacatgacttcgtttgtggattttctccaatttctttttgtaaaaaatccctcttggaggttttcacaaatatttattgagcacctaccattttttcatgtcagggtgtggagctcctcgctgacctggaacctggcttccctgcctcgtgcctgtgccttcctgccctctcccctggcccgggtcgctgtggcccatggcctctctttgcccgctgaacacttatccctgccatcatgtgctca

SEQ ID NO: 2628 - DNA, 437 bp, Homo sapiens
actagccccctctgtgcttttagcatttgacctagaggctaagcactcagtaatgtagcttgccccagtgagaacatttccaaataaggaagccagccctgggataggaacgccactgtaaactggggcagtgattctgaggctggcaaatgaaataccgtttatttccaaatgttcaggggaaaaaattccagccttcagagttgaaagaacaggcaaaaacgagaaggataagagatcattccttaatcttgcagaactgcattagctaaaggctgccagaaaatggaaatttggcaaagactttgcacattgaactgtcctcaagctgaagatctgagaggggtgttctggcagcatccaggtgtaccgtgagagattacaaagggaaaacacacatcttatctgtgctgcacagcaaactactggaagagagc

SEQ ID NO: 2629 - DNA, 472 bp, Homo sapiens
ttttaccatttgcaagattctgatttactgcattctgatgctaaatgaaacagatattatctggaccattcaacaaaacctttactacatgtagactatcaagtctattttacctaaagtacaaatatatctttcctaggtctccagtttgatgccaccagttctcttaagtagcaaaccctgcctggttccaaaggtatctgagagacctcaaacataaaatcattacaagaaaaaaacagatcaaattcacccaaagtaggaatctagcaaaaatctaaccaaatatggctaccttaatcaaacaataattttagctctagacttaaagacagtggcagcaaacaacaataaaacaacaaaaaagcaatcacagcaagctctgtaattcagagagaaaaaccttactgtcactaacatttaaaaggaatttttcagatgcgtcattacacaggtacgttgaacaaaataa

SEQ ID NO: 2630 - DNA, 482 bp, Homo sapiens
tgacatgaaaagtaaattttattaaacatgtttacatacatgaattggaatttcatttaaaagcacaggggagtgttaagacaagtggtcaaaatagaaagatactacccaattataatcagttgattgttggccactaagacagaacggaatctagtagaagtgcaccaatgcttcagttcctcctactcagcatggtgagcagtggtcaatctgtgccctgtggaatgatgggcagataattctggcatgtgtaaataataataaataattcacttggtgcaggcagtatgtctatgaattaaaacctagtgtgtacacagtgtctacatgtgttacagccccacagtaggaatctacaccaaaatatttattagaaggaatttggtccgtactacatcacgttttccggagggtaaaaaataaagtccatctatagacatttcaccacagacccagagactgagtctggctaaaacctg

SEQ ID NO: 2631 - DNA, 568 bp, Homo sapiens
caccactgtattctgggtttcaaagacttgtaattcatttcattaagactctccaaaccatccccttaaacatttgtttaaatgtctctgttcttcattagcgttttattacgttacattctctaggctccagaaaaacgaggcaagaaataggaggatttttttttttgccttttttcttttttttggttgaagttttggtcaaacaagccaaaataacattatcattaaacagatcgacctgtacttttaaatggaaggaataaagatataaaaagaactgaggcgtgtaagtaacctctttgatttttaatggcatgcagcagatggaattcattattgactttaaaaaatgaaattgctctgcattattatttatttatagttttgcctttcaaaagaagtaattaccattactaggttagtttttcctcaatcacaagcaactgtgtgacagtatcagaatgtataatatactttaccacttatttagacatgaggcttaatgatgttgcaggacattatccctttttaagttagtaataaatttatgagcataatgcacagc

SEQ ID NO: 2632 - DNA, 381 bp, Homo sapiens
atccatctccctttgaaacactcttttgtgggcaaggttgaaggaaatgctagactcccagcattaaccttccagcatccatcttgggtcttgggaccacttcttggtctggagttggaaaaggcgtcctctctgccccttcctttcatatgtttgaaaacagctttgtggtcatcagtacccaagtcaccatttctgtacttcacgttcatctccagctcacattctgatgtcctcggaggacaggaaccacactcctaataaaggattcctactaatagtcagctcccgcactaaagccagggtcctggtccaggtgtgatagccttcatgtgtgtcagctcagggggtccttgggagagcttctcatggtgggtgtca

SEQ ID NO: 2633 - DNA, 288 bp, Homo sapiens
gtgcacattacacccatgaacttagaccagttgcctttatgtatgatcgtatttatactgagaagttactgtgttttttgactttcttttctatttgctacatattagttcggtctaaacgtttggtcttctggtctccatagttctacattggttaaatgcaactcacttctgggagtagtggtgacattcaactagtaggctttttaataaactacagaagttcattactctcatgtaaggaaggaaaactaatgtaactttcgttaagtatgaaaagcgttggat

SEQ ID NO: 2634 - DNA, 184 bp, Homo sapiens
aatcatcatttgcataaattcagcctgtagactaaaaatagggccatatttaaattttaaaaataatgacgtgttcaaatacaatgtttagagttcttatttggataattcagcagcatttagaccatattttgatataaaaaatagtataaatactatgagatataacatatttgacttcaaa

SEQ ID NO: 2635 - DNA, 433 bp, Homo sapiens
tgcatgaccttggcttaatcaacctctctgggcttcacttccctgtgtgcaaaatgtgtgtgaagaaatctgtgtgaaggtgaggagaaggctgaacttattggcagctctaaaggtgtgtaattccacagtactgtgtgacaagtcccctcatgctaagctgggcttccagtgacaggcagggctctgtcttctagaaagtcctctctctaaacccacagacttcctcagcaatgggctaagtacattttggagaggctagctcagcgacaggtgcaaaggtactttctttccattttggtagctgcactgactaaaaaagggttattgccttcttcagtttgtgagcatttagaagttatagaaaaaaacgaaaatcagtgtcaacaagtcccagaggtgatgggtctaatggtttttctcctggtgagtc

SEQ ID NO: 2636 - DNA, 132 bp, Homo sapiens
gttatttaccaatgacctggtaattattgaaaatggttatatattcaagaatatttgtgctgagtgctgtggctcatgcctgtaatcccagcactttgggaggctgaggcagggggattgcttgagcccagg

SEQ ID NO: 2637 - DNA, 460 bp, Homo sapiens
aagtttagatactacctgaggctctaagaagagatccagaatgccccacccccaagccttgactcagagtggcagggagaaaagatgacaggagcctcagatctcagacccaacatggtgtgccagctttagagcagcattggtggacggaggtgccaggtggtgagatgggcatggtgctcctggcagccttgagccacaggtgccaccagagagtacatgcaagtatcaacagccctagagttggaacaaaaaggcttatagtgagagacaccctgaccaggggcaatggcagggatcatggccatcagcatgaaacttgctctgtacccaagacaaggtaggagccaccaaagcttagtggacaccagtgcagggaaaccagcagccaaggtgggagtggggagccacccagaggaggttggcagggccctggaggacagcacatggagcccagacc

SEQ ID NO: 2638 - DNA, 361 bp, Homo sapiens
cgggaacgtggtgctctgaagttcctttactcactccttccttgggtctggtccaggtccaggagcagggtcctgatgcccagtgatgctgagcagccagccccgcttccttcctctttaaccatgctgtcttctgtcacctctctgttaaattttgtttttttctcttaaaacacttgttccaagtgtgaaggtttactcaatattttggttcttctccatgagagaaggcacaatccagctgcatctagtcagccatcttttaatctctctacaaatcttgataaaatttattttatcaaactgtaaaagtacttatttagaaatagatctcaatgagaaatgtggggttatttttcaa

SEQ ID NO: 2639 - DNA, 747 bp, Homo sapiens
ctgccccctccctcctccctgacacatggggctctggcacaaggaatctattctccaatttaaaacaaatcccattgtgtcctccagggccaaaatccttcagccaccaaactgttagtattctctctgaattagtgaccaataatgctagcattggtgaaagttcccagtgttctacatccttgccaacatttactagtctttaattttagtcattctataggtgttcagtattgtctcatcgtggttttaatttgtatttccctaaagactactgatgtagagcatctttttatgtgcatatttgccatacttacattttctttagtgaagtgtctgcttaaatatcttgaccatgttttaactaagttgctttgttttcttactattgagtttagagaattctctacaaattttggatacaagtcctttatcaaaaatatgatttacacatatcttcttctattctggagctcgtacttccattctcttaacagtgtcctgacaaaagacattcttaacttcagtaagtccagtatttctatttttttctcatgtggatcatgttcttggtgtctcatctaagaaaccttagatttctaacccaaaatgagaaagatatttttccctgaactttgttctaagcacttctgtttttaggttttacattttaagtctgtgatccatttttatcaatttttacatattgtgagaactatggattgaagttcattcttttgcatacgg

SEQ ID NO: 2640 - DNA, 560 bp, Homo sapiens
acagccagctcagctattaacacattgtgtgaccatagctagttacttctccatgctggaactcagttccctctaaaaaattggagaactgaagcaaatgagctctgtaattctatgaaaataaacgcacaggataaaaaaagagaacttgtttcaacaagataattctctgtctttggcctagttgaggggtccccaacccccaggccatggaccagtactggtccgaggcctgttaggaacccgatcgcgcagctgtaggtgagcggggcaagcgagcattaacgcctgtgctctgcctcctgttcagatcagcggagcattagattctcataggggcgggaacacaattgtgaactgttcatgcgagggatctgggttgcccgcagcttatgagattctaacacctgatgatctgaggtaggacagtttcattcatcacccccccatctatggaaaaattgtcttcctcaagactggtccctggtgtcagaaaagtttgggactgctggcctaggcgatcacttctctcatttcagcttcactttctgacacaggag

SEQ ID NO: 2641 - DNA, 392 bp, Homo sapiens
cagcaggtacaagactagtataatctggctccagaacaccacttatataagaagaagctgagctagaaaaggacatggaatgcttgagaaacaatagaccaccccaaggttctaacacttaagtcctggatctcaaacattccatccctggcaccaaaatagcataatggtggactggatgcacctggaaattaataataaccagaaaagaaccattggctcccaggtaaccatctacttgtcagacatggtgttactcctttaagccaattatgctcaaaataaggagtttgtccctcctagaaaacacatccaaactcacaaaatagtttcatttaataataaattccccccttgtcacccacaccaccaaaaaacaccaacattttttc

SEQ ID NO: 2642 - DNA, 460 bp, Homo sapiens
gcctttctgtgtacccgtttcctccctcagggcaagcccctgcactctggtctgcaccagctgagcaagctcagcatccacatcagcccagctgctctcctgtctctaacagcctgtgggagatttcctcttggatcacatatccttgccttaagccaatttccctattccaggagctctcaaacttgagaggcatgaaaatcaccaggtgggcttgttaaaacacagattgccaggcccacccccaaaatgtctgattcagcaggtctgaggtggggcctgaacatctgcccttctaccaagtgcccctggtcccccactgaagacccctgccctctgtaccaccatctgccactcagatttgcctcttccttccctcccttggcacctgcagccagcaggctccaggctttggacttttcctctgtaggaacttttctcctcagcccttccttattac

SEQ ID NO: 2643 - DNA, 434 bp, Homo sapiens
gctgccttaattcgtaggatagctaaagtgtaattattatgtgattacaccttattatgtaattattagacagaacccacttggagctgagagccccacagagggcacagcaggggcgtgaggtccaacaagctcaggctgtgtgtgcttctggcccagagaagacgacagcgctgggagagacagcagccacagtttctctagaaacactagaatcccaggagcagctgctgggcaggggcagatgagggggcaggtgtcattatcatgacctccactttatagatggggaagctcaggtacaaagaagtaaagtgccttatataagtcacgtagttaagtcttcaggctgagattcaaaccaggtctgtctaactttaaagcctgttttgttcactctccctggcagggctattataaccattacatgaaat

SEQ ID NO: 2644 - DNA, 412 bp, Homo sapiens
gtttgaagataacagggaccttgccttgctcagggtcaacattgtaaacctcaatgcttattgtacagtagtggacataggtagagaagaccaaagagacaggctgaatggctgctggctacaagacaggcctggaaatgggccactggggcacatcctggctcatcggagcccttgctgtcatttgcctctttctactgaaaggatagtaagaaaacataattcttgtcaatcgaggttttggttaattggtcctgagtttttagaggttttccatatatacatatatttatgtgtgtatatatatatatatagtatatgtatatatgtatactatttttaaattatagaattatacattgaccaatctccttagtttcacttatgtggaataaatttggcaatccaagga

SEQ ID NO: 2645 - DNA, 447 bp, Homo sapiens
ggcaggagaattgcttgaacccaggaggtggaggttgcagtgagccaagattgtgccaccacactccagcttgggtgacagagcaagactccatctcaaaaaaaaaatttgttatacaaaggaatgaataaatgcatattacattattacattcctattgtagagaagaggaagcatagctggtggcaaaccagagatttgaacccaggagttcctgatccctgtcttgaacactttctttttcttttttttttagagatggtgtcttgctatgttgcccaagctggacttgaactcctgggcttaacggatcctctggcctcagcctctcaagtagctaggactacaagcaagcccggctagcttagaccctttgtatggccccagtgtggggcctcatataccctttggctgtgtttgaggacgtgtttgacagatttgatgatc

SEQ ID NO: 2646 - DNA, 112 bp, Homo sapiens
gtaactttaaattggccatggcgaaagtatttacaatgtagaaatcagccaatgctacacgtttgcaccaccctcagcacccggagattatttgtaaaacatttaccagtat

SEQ ID NO: 2647 - DNA, 292 bp, Homo sapiens
gacaataagaaacacgtggaaaacggcatgtgtgtagcaggcaggggtagcagatagtacaaatatattacccctgaaattcacaggcaagaaatgttgccatttttaatataaaaatattatatgaaaaaacatgaaaagttttattttttcatagaggtcatgtgtaaagcattaataagctaaagtacacaaagccaaatgacaaagcttgattaacaaactgcccacaaagctcatatttgcctcagtgtgtttaaagatgcttgaaggctgtaaatctctgaccctt

SEQ ID NO: 2648 - DNA, 467 bp, Homo sapiens
ccaacaaatattttaaacaaacaaaccaataaattaatatttcttaaaccagtaaagaatgaaaactttccagccactcatcaggcatttgttcataactgcttggtgtcattcatggtgagagattttgctgacacaatgatagctatgaacaatccctgcttccagaagcctatggtgcagcaggagaggtttgtacccacattcatggcatagtgatggagagtgttggtgccagaacagagatacactgaggcctttctgaagggacccagaatggagcatcttcgacttcatgtgtgttcaagaaggtcttcataaaggaagtgacaaacatattcaggtatctgaaagttgaacacacactgaggcttacactggacagaagacagaagggtagtgtcgtccctgaccctgaggccttaaatccctattgggaagtgaacacactgacagattttcacata

SEQ ID NO: 2649 - DNA, 362 bp, Homo sapiens
cctgctgccggagttgggattcggcagtgttctccagtgaggggctgggctgggaagtcctgcgtttcatttgagcatatgagcgtcaagtcctgctttctcagtagtcccattgctgggccccaccattcatcctgtctgaaggtcctggttggtgtgaccggttggtggctggtgagtggggtttccaagtgggtgacagcgctctgtggcagccggggatggccttgtccgcgctgaccaggcctgtagagagtgctcagcctaaccttagaacacatttataactgaatacagtgttttcaatttgtacataatagttagaatattctattaaagttatgaaacacggagaaaaaaaa

SEQ ID NO: 2650 - DNA, 403 bp, Homo sapiens
gttttgttgcctccagaccactactatccccttcagcaatgaggcactcattccccgagctgctgctgggacagctcacacctgagcccctgcccaggcacacatgctccagtggctgaccgacgcaggggtaaaaaggtcttgtctccttgccctgcaggtacctctgaaaggcccaccagctctcagtatgatgagctgaggcctaaccgcagctactcaattctccttcttccacatccttccaggtgttggtcctgagtgttccccccagtaaacctcccgagcaaatctcagtctctcatccgattcccctgaggcctgaactgctgtgtaatatttcactgcatggctgcaccacatgtcattaaacagtgccctccttaggcgcattcagcttatt

SEQ ID NO: 2651 - DNA, 478 bp, Homo sapiens
ctgggggccttgaggggcatcttcctgtccccgagagcctgggttggcatctcaagacatgagaagggagatactggggtgcaggactggggttgtccttgggcctctctcaggttacccccccgaataggcacttgcctgccccacctcagctctgggacagctcccatccaactgggggtactgggcaaccttgtgcaaggggcaggaagggcccagagtggtccaggattcccccgagatcacacagcagggtggggtgcactggctggagcccattttgctcatccagaatgggcctcctgtcagccctgcccgactctcactcctctccaccaagcctgctgctcctggagggcagagcctatatatagaagcctttaaacactaagatgctctgacaattaaaattcataatttatcaacacaactgccagacgctgcaaacacaacggcaggcatcgcaaaaacacaacgg

SEQ ID NO: 2652 - DNA, 285 bp, Homo sapiens
gctacaaactcagccgtacagttcgtacactaaactcttgttgcttttgcattataaggaattaagtctccgattattaggtgatcaccctggatgatcagttttgtgctgaaggcacctgctcagtatcttttcgtctttatcactctgcattggtgaattcaatcctctcctttgtgctcaacttttgtgtgcttttaaaatcagctttattctaagcaaatctgtgtctactttaaaaaactggaaatggaaaaaaaaataaatctttgccaaatccttcaa

SEQ ID NO: 2653 - DNA, 519 bp, Homo sapiens
ttattaagaattcatacttaattccactgactgccactcaattttaatgtacagtagggaattcctgtactatgtattatgaatccattcctttgaatttcatttataatacttcatgactgacacctggctttccaccaagactcaattttcatagcaagcctcatcatcataagcccccaaattaacaggatgaggaggaagaattggcaggctaaagaagatgattatatcaattaatgcagaaaaagcatttgataaaatccaatattcatttgtaattaaaaactctcagcaagttagggataggaattacttcaacttaatgaagagtgtctttaaaaaccttattttcatcagttataacaaatgtaccactctggtggtgaatgttgctaaggagggaagctatacatgtgtggggaaaggagatgtgtgagcaatttctgtaccttctactcaatcttctgtgagactaaaattgctgtaaaaaataaagttcatttttttaaaaaccta

SEQ ID NO: 2654 - DNA, 921 bp, Homo sapiens
ccactctggccaatagtttacttcaaactggaaaataaaaccactttctcagtgccatgtcactactttctagtggtgctaagaaagtagtgttggacattcatagcctacagttcttttttttttgaggtggagtcttgctctgtcgcccagtctagagtgcagtggcacgatctcggctcactgcaacctctgcctcccaggttcaagcgattttcctgcctcagcctcctgagtagctgggactacaggcgcctaccaccgcgcccggctaattttttatttttagtagagacggggtttcaccatcttggccagggtggtcttgaactcctgacccttgtgatccacctgccttggcctcctaaagtgctgggattacaggcgtgagcaaccgcgcccggcctgcctacagttcttatattggttaatcctgtaattttactaggaaagtattttctcaagtcctttttgtagtattgtgccaggcattggggttccatggctgaggttcatgagttggtgatatcatgtcctaattcttcatttattcatcaggttttaagggaaataatagaaccagggctatagaaagtagcttccatgaggctagattagcttttgctgaatattctgagatctaaatgtatacggtaatatatatacaggcacataaatactactaacaaacatagagcagtgcttggcacatcatatgaagagttttatgcacagtagcttccttaatgctcatgataattttatcaagtgtgtactgttgtcttactttacagataaactgcagcagagagggtaaatgacttatccaaggtacacagctaggaagcagcagagccaggattcaaactgagatggaacacatgaccacatcaggtcctgccccacaacatgtgttattgg

SEQ ID NO: 2655 - DNA, 534 bp, Homo sapiens
ttttttcctgtgttttcctttagttatttgagcatataaaagacagttgatgtaaagtctttgtctagtaagtccaatacttgtttttcttcaggggtggtttctcccagtttattttctttctttgaatgaacatgtttttcagtttctttatatgccttgtgattattatttgtgtgttgataattgagcatttgaaaaaacaaccacctctttcagtctttacagatttgctctgtgcttgaacagtcctgcacaattagtcaggtatgcatgccctgagtcttgggatcagcctgaggtgatagctgaaggtcttcttaagtcttttctgtgtatatgtcttgcttgggccctggtgtggctttttaaatcccctgtatagatagctgaaatttgaatatcttagtttccaaaaatgtctcattccagtttctccttgggacattagatggtccattgtatgtctccacctatattttcttgtcccacacaactacaggtctgttgctctcttgcagctttcaaaagcaa

SEQ ID NO: 2656 - DNA, 339 bp, Homo sapiens
aactgtagacagcatgtgagctgcttgccaatgccacagatggggtcctctgtctggggataccccagctttgctgcagtagtctgagtcccacaggaggaaagtcatttgttggtggccacacaagacacagagccagatgcaggtctcctggtagttttagttttgaatgggggcaacttggtatcccagagcactttctctttgccaaatcaaatagctcctccgaacactgcccacctgccctggccatgggctgggaagaggagatttggggtgctccttaagccctaggctcctgggaaaacactgcccatctggctgagctgggaactcacc

SEQ ID NO: 2657 - DNA, 389 bp, Homo sapiens
  misc_feature (356)..(356): n is a, c, g, or t
ggatggatatgttcattggcttggaatcattccacagtgtatacatacaacatcacattgtgccccataaatatacacaattatttgtcaattaaaagaaattagtatccgcaccctcactaggttggtgcatcaaagggccctctgtctgggaaggtgacatgaaggagggaaagatccctcctgatgggaaggacctgattgtagtaccctttcctgttggcttacccttgattgggacatagtgcagccacatgcagcagggtgttgtcatgtggacgatttcataaaaacacaacccatctctagttctcacttcacctgaggctcaggtgatccaccttacttgggccttnccaaagttactggggatttacaggtcatgtagg

SEQ ID NO: 2658 - DNA, 443 bp, Homo sapiens
gtgaggttagaaaatgggtcttcacatgacctcattatgataactgctattattaatgatagctgtcatctatttagtgcttactgcctgccagggactctgcctagaatcttaaatagatcattcttacaccactgagttatcattatcggtgacattttacatgaagaaataaatctcagagaggtttcacaacttgtccaaagtcacacagctagtaagtggcagagtggggatttgaacccaggtctttcctattctgaggtttcctataaccaggctatcctgccctcaccaccgctccacatatgctcgctactagccagttcaggggtgactgaggaatgattttaggtcacatgggaacaattttttctatgttaagtggtggcatttattttggtaagtattagaaaaataaaattagcacatcaaacctgtga

SEQ ID NO: 2659 - DNA, 413 bp, Homo sapiens
gtcatgtgttctatatgtctgcatgtaatgccctttctatatgtatttttctcctctgtgtgtagagaacagtggttataggcatctataggtagtccaaatacttaaaaaacaacactaacggccgggcacggtggttcacacctgtaatcccagcactttgggaggccgaggcgggtggattgcctgagctcaggagtttgagatcagcctggctaacacggtgaaaccccatctctactaaaatacaaaaaatagcctggcgtggtggtatgcacctataatcccagctactcaggaggctgaggcaggagaattgctagaacccaggaggtggaggttgcagtgagccgagatcgtaccactgcactccagcctgagcgacagagcaagactctgtctcaaaaaaaaaa

SEQ ID NO: 2660 - DNA, 447 bp, Homo sapiens
tgaaacctgtggagagaaacaacaagggtgacaaggctactcaggaaggaaatgaatccatgacttcagggactctcatctgttcagtaatagtgtgaagtccatttcctatgtcccctcacttcccagaagcctggtgagggctgccagggggaagggaaactgtccagaagaggtgaagtaagatccatgtgctagcaagcatcccctggagagaaaggagatgaggcagccaatctgaagacctcccaggtaacatttcagttgatgatcagatcccatctcctggccagcatccccagccctgcctggtgtggtccgtccctgtctacatgctggctcttttttgaacaagacagatgttgggggccgggcatggaggctcatggctgcaatcccagcactttgggaggccgaggtgggtggatcactcgaggtcaggagttc

SEQ ID NO: 2661 - DNA, 418 bp, Homo sapiens
ggattggccacacacgttggctcatgcctgtaattccagcactttgggaggctgaggtgggagtatcccttgagcctaggagttcaagaccagcctggttaacatagcaagacctcatctctacaaaatttggaaacttagccaggcatggtggcatgcacctgtagtcctggttactcaagagaccgaggtgggaggattgcttgagcctgggaggttgaggctgcagtgagctgtgatcactgtagcctagccaacattgcaagaatctgtctcaaaaaaataataaaatgataaaaaatgtaaatagaagccgagcatggtggctcatgcctgtaatcctagcacttggggaggccgaaggcagacagattgcttgagctcaggagtttgataccagcctgggcaacatggtgaa

SEQ ID NO: 2662 - DNA, 286 bp, Homo sapiens
ctgttattaccggtctttaatgacagctggatataaattcttagacactcatggcaaaaccattgtcaaaacaatctgatttcatactgctatggatggtccatgttatttgtaactcatttacagtgagaataggaagacagaggtgtctggctctacatagctattaaaagagcttttacagtgtatgtgatgctgggttgaattgacagtttgttaaaactcaagtggacagtattcagtttcctacaacagacatattttaactgctttgtgattaagttta

SEQ ID NO: 2663 - DNA, 403 bp, Homo sapiens
ataatgttgcattgaaaattaaagtaagttggaacagttaagctattttgtttttaagagcgtataaatacctaactttaaagtagtttaaatgatttctggttacatgttttcatttttaaaaatatggactgcaggacatttttttttgtgactggagtatgaactagatgtcaaaaaacagtgttaatgcttactgtcttttaaagccatcttggaagtttttacttgtctaacttttcttctttcctttgtaaaacttaccgtacagaatatgtgtacatggaaaaagtcttctttttgcagatttaaagtctttaattatattagaaaattttcagtagaaaacaactagttttatttttaattctaaaaaaataaataatgacctcttaacttctta

SEQ ID NO: 2664 - DNA, 483 bp, Homo sapiens
ttttggagcaacatggctgtttatttcacctgggtgcaggtgggctgagtctgaaaaaagagtcagcaagggtggtgggattatcattagttcttataggttttgggataggcggtggagttaagagcaatgttttgggggcagtgggtggatctcacaaagtgcattctcaagggacccagccctctattttcaaagaataggttctatctaatattatcatggtaaatatccatattagtttaagagagaaatgaaaataatttttgaatcctgttcttacagacatcaaagaaagcaggacagaatgcacattgcactattcaatttgttgatttgtcctctgtcatcttgtggagagtgatagagtattttttaatttcttcaattaggatagtccaattgcaataaggtggcataaacatgctgtctcatgcttaaatagtaaagactagtcagcagtcagttatatatataattgtc

SEQ ID NO: 2665 - DNA, 502 bp, Homo sapiens
gttctaaacagaatttgtatgaaggagggcatattctcttgtgaggaaaaattcttgcatgtattcaaatatgaattcttgataaagaaaaatatgccctttggttatttatttatttatttagagacagggtctaattctcatccaggctggagtacagtggcatgattatagcttgctacagcctccacctcctgggctccagtgagcctcccacctcagtcttcccagtagctgggaccacaggtatgcaccatcatgcctggcaaatttttcaattttttttatacagacagagtttcactctgttacccgggctggtctcaaactcctgggctcaagcaatcctccctccttggactccggaagtgctgggattacaggcatgaaacaccacatccagccatgtcctctggtcttaaaatgactatttttccaatgcactattaatttcttacgcaaaatatgcaatcgagatttcgtatgaaacatattgacagca

SEQ ID NO: 2666 - DNA, 316 bp, Homo sapiens
tctaggacagtaggaaaatgaattgacagaaaagtttgagtagtattgctactcagttgtggtcaatgatcatgaaatcaggttgagatcagagtcagcaaagtatatgcttttctgctactgtaggttttatcagacagttatgaaagagggagggaagggcaaggcagtaattataatgatgggccatttaaagttaagatggataagaaagtagggggcctgggcacagtggctcatgcctgtaatagcactttgggagactgaggtgagtggatcacttgaggtcaggagttcgagaccagcctgaccaaca

SEQ ID NO: 2667 - DNA, 552 bp, Homo sapiens
tcccttcctctctctctctctctcacacacacatacatacatacatgcatggagacacagatacacacagttgttttgcattgtcttttggattctttttcagtcactatcttcctgtatgttccacagctgtgaggctaagcagtcacagagaatttcagagctaactgtaaccactgtgcaaaaaattagctcaaatcctcagcaagggggagagtggctgcttatccacccaaatgaggtcatatcttcctctctctgttggtcctctgtaaataaaaagactgacaatcctgccagctttgctgagtaatagaacttaagaaagctgcttccccttgggccaaatagtagaggatcttgtcatctctctaggagccgtggtgtattattgttctcttctgttcttggagagggaaggagttccttggggttggcaaccatacttctataggatcttcaataaggaataactgcctacagaatgtgggaattttccacatgctttgccagtgccagagattacaaaggcggcaaataggtagcttttgc

SEQ ID NO: 2668 - DNA, 353 bp, Homo sapiens
aaaatggcagtttctcttgagtaccaggatggttctagctggtaactagagaagatatttcactctctgagcctcagtttcctccttgtaagttgagaataaccacacctatcttataggactatggtgagagtaaactcatgcggtaaaccatgtaggaaataccctagttgtggccttctcccctgggtggaactttaccctatgaaggtttagcaaatcattcaacacaatcaaacagtggagtctaggggcaggcgacatggctccaacctcgcctctgccttacttcgtgagtttgatcaacagtttgaatctaaataaaagctaacttttatatatctgatgaacca

SEQ ID NO: 2669 - DNA, 699 bp, Homo sapiens
tttctgttttttaattggtttttccctgttctctaaaatgagtgtcttattagactaaactggatatagccctacccagtgacctgtagagtcaggaagggcttaaactctttcagcaatgaaaatcttctgggcacctgctgtgtgtgagagagagaggctttgttctgggcatatggccacccctcctagagctttgcccacccctcccgctgcctctacacttagacagcattcctcaggaggctgaagacactgtgaggaacagcggctcttgctctgccaggcggaccacaggccccacatccatccaccagccagtcccatcagctctaccttgaaacagagccagcatctgacccctggccaccaccgccaccacaagcacaagtgatgttctggtaaatgctcaacagccagctctctggggcgcagaggcaggccctgctgtggggcgtttgccagtgtccatggtgtgaatattcccgtcatggccaactcctggctgccaacatgacatcgatgtggacttgaggggagatgtgcagtggccacaccagcacaatggacagaaataaccccatcagcatagacgatagtaaagtggaacaaaataattagcaagtggtatgctttgagtatttgttacctttgtttttaataaaattgtatcccattgtaacgctgatataatttaat

SEQ ID NO: 2670 - DNA, 221 bp, Homo sapiens
agtaatttcaccatgaatataatactcctcttatcattttgtattcccttccaactaatttttctcttaaaagtggcactatgtttttgaaaaagctgactactttaagaaaatttctctcagtttactttcttaatcgtgtgcttttctgaagagttggctctgacgttgactactatagtaaatccaattttgatgagtttttcttttttagtgggcca

SEQ ID NO: 2671 - DNA, 418 bp, Homo sapiens
acatcagtcagagtaagggctggttcaaggagagtgagtgcccatacttggctttgagtgatggagtggcctcttgtctctgatcagagaaagccacatgccagtcttgcagggtgtcaaacacatagcatgtctgctgctctgtgtgctgagtgcctgctctgtggctctcctggccctgtgattggcggttgattgcatcacagacacttgtctgatctagaccttgcccaaggtcatctggcggcttggtttttgcaagtgactggggtacacttgccacatggaccccttcctccccagtatttttgttgttgttgttgttgttgttgttgttgagatggagttttgctcttgttacccaggttggagtgcagtggcgcgatctcagctcaccgcaacctccgcctcccgggtt

SEQ ID NO: 2672 - DNA, 387 bp, Homo sapiens
cactggaaattggaaacattgctggtaggactgtaaaatggcaaagctactttgaaaatcagtttggaatttcttagaacgttaaacatatgattgccatatgacccagcaattccacttctaggtagaataggcaaaactagtccgaggacgaaaaaaaattgaattgatggttgcccaacgtgaagaggaggaacggaggcgaagagacagcaaggggcctcaaggggccaatggcagtgttctatagcttgattgccatggcttgattgtcgtggtggttatctgggtgtatacactttttaaaacttcatcaaactatgtatgtaaattataccttaatgaagctgctctttaaagtaaaaaatcatcagatttcatgtctat

SEQ ID NO: 2673 - DNA, 470 bp, Homo sapiens
ctaacaatcctcatttttcctgtcttaactcagcagacttaaccgtcagactgatggttagctaatttgttgctctgcccattcagcattggtgaacaacctaagtcatgtctgtacttctgtgagcgtctaagccttgcctcagcttttttgtatttacttagaaataatgtcctgggtggccaggcgcggtggctcacacctgtaatctcagtactttgggaagacaaggcaggtggatcacctgaggtcaggagttcgagaccagcctggccaacatggtgaaaccccgtctctacaaaaaaaaaaaatacaaaaattagctgggcgtggtggcgggcgcctgtaatcccagctactcacgaggctgaggtaggagaatcacttgaacccaggaggggtgggttgcagtgagccgaaatcgcaccattgcactccagcctgggtgaaaagagcaaggctttgtctta

SEQ ID NO: 2674 - DNA, 421 bp, Homo sapiens
gcctccccagtcatgcagaactgtgagttaattaaacctcttttttttttttttttaaataaattacccagtcttggggagtgtctttataacagtgtaagagcggactaatacatccagcaacctggtgagctatctgtgattttagtcatttacagcaaaaggaagcagaggcacagcctggcctgggtttgcctgaggttccacagcttcctgaccccattgacgcctatctttggcttcatcacatttggcatatatgactttgcttctatagtgggcatgcagcttgcttatagactctggaagagcctaatccttctgcttctggcatctctctgggaggcaggccagaatttcattaccccttccatgatcaggccagggtcatcccttcatcccatggatatgagtatctgag

SEQ ID NO: 2675 - DNA, 238 bp, Homo sapiens
aaaagaaatatatatatatatacacacacatatatacacatatatacatatatacacatatatacatatatacacatatatacatatatacacatatatacatatatacacatatatatacatacatacacatatatatacacatatatatacatatatatatgataccaatgtcctctatgtcatacgaaagccaatgttgttacaaaaggcagtgagatccaagtctgaagaagcc

SEQ ID NO: 2676 - DNA, 1021 bp, Homo sapiens
tcatggggaatttgtctcttttctcccattaatttattccaaatttaatttatatcatggatgtgtgtgtgtgtgtgtttaaatgttggattataatccaatactacttgattttgttgctcaaaatgttcagcattggccattgagagctgattttggctcctgtgatctttagacatatctccattaatgtattttgtttctttttctttttttcccagcacgtccttactctggcactacgaaatgctccagactcgtgtgtatttcttgctccaccatagaatcagccatttctacaaatgtcactggtttcttttatggagaatgacattggaaaccaagatctgactactaagtgtgttctttgctactgggttgtcatttctcttaaggcttccaagctgacagagcaaacgagtatatgacacatctgattttttatttgactgtggaactctgtatctatgtgagaggatttaattgtttctgattaaaatttctcataactagttctacaatgatattttaattacaactgatacaaagcctataacttaaaagattctcttttggtatgagagagtgataagttggtttgataaaatttttctaaactcatgtctgagttgttatgtatttatactcattaaaattttagaacttactatcaagacctttatgatatactttttgtcctataaattctggcatggtctttgccccaaatagcaaaatttgacatgactctaagagatcttcttcaaagtcataaaaagcaatgaatttaataggaaagcagactcatgatctttagaagtgaaattgaaatgcaacttaaatatcaagatttctggtgtttctatttgtcagttgtcactttattaattactatctgctaaaaaactgtcagaatcaggattttgtaagtcataaactcaaaatcatgcttcttatggtatctatagaaaatacaactaatagactgaattttacttcctagaagtatattatgtaaacc

SEQ ID NO: 2677 - DNA, 992 bp, Homo sapiens
tcatggggaatttgtctcttttctcccattaatttattccaaatttaatttatatcatggatgtgtgtgtgtgtgtgtttaaatgttggattataatccaatactacttgattttgttgctcaaaatgttcagcattggccattgagagctgattttggctcctgtgatctttagacatatctccattaatgtattttgtttctttttctttttttcccagcacgtccttactctggcactacgaaatgctccagactcgtgtgtatttcttgctccaccatagaatcagccatttctacaaatgtcactggtttcttttatggagaatgacattggaaaccaagatctgactactaagtgtgttctttgctactgggttgtcatttctcttaaggcttccaagctgacagagcaaacgagtatatgacacatctgattttttatttgactgtggaactctgtatctatatacacttgcaattcttatcaagtaaaaatacatcaaagatatcaacaaccacagacgtatacacccgacaagaaccgctgtatattctagtacatcatttattggaccaacaaatacatggcatctggcaaggaattgaaaagtggcttgtctatctggaatacagggaggaaggagttgaaatgagatgggaagagtcatctgtatgcagaggaggtataaagtcatgcaaatggataagatttcaagaagaaagaagaaaaaggtaggctctgagtttggagagttgaatgagcctacagagataatgaagttgttgctggagagcctccataacttctgttgagaaatcggccttaatcttattgatgatgactttcacatgatcctcagatatctgcctctagatcccagatgagcaccagttgcagcagtcaaacgtcatctatctgtatatcaagataaattatgaaaggattatataccaactgtctaaatgacaaagagaagaaaggtaagtag

SEQ ID NO: 2678 - DNA, 540 bp, Homo sapiens
tcgggttcagtggcaaaggtgaagaccagcactgccgacctgggacctgggcctctcccgggcctggggaggacactggactttgaaggggaatgcagcctagaaggcctggaccctggagtcaggagatgctgctcccatccagtaagccctggctggagctcttctgggcaccaaccctggcataaaaccagtggggcctctgggcctgcactcaacagtgcctctgatggagcaggttcagcttggttgtgacctctgctagaagccctccctggcctccctgtgcactgagctggtggttcctcctttgcgccccaggtacatgctcagatctgtgtaccctacactttgtcctccagcttcgtgtttggatgttcacaactcccatgagaagggcccccgagagctggcacagtgcatgtgtttcctctccagacttctacaaacctggcacataattgtttgctgaaagatggcatgttcctaaaacagaggaagtagaacctgaataaagcgaaatccaacttcccactccct

SEQ ID NO: 2679 - DNA, 316 bp, Homo sapiens
acccacagatgtgaatgtcgtgtgatgttggctttccagtgtcttgcatggcgtggtagcagcagaaatgagcttggctgggcaccctctctgggccttggaggcaagcctgggctcctctgaaaatacaggcagcttcctttccctgacttgcctggaggagccaggccctgtggtgcggtctggctctgaggcctgtggtcctgcttgggactggcagtcttaggctgagggaacattttccagagtatagccgagggacagaatgtctcagtaagacgggctcggaggggaagtgttttggaaaggcctctgc

SEQ ID NO: 2680 - DNA, 769 bp, Homo sapiens
gtctggctctgaggcctgtggtcctgcttgggactggcagtcttaggctgagggaacattttccagagtatagccgagggacagaatgtctcagtaagacgggctcggaggggaagtgttttggaaaggcctctgcttgctctgggaggcgttcaggatgctgaggttttggaaatctatggcggctcttcacaactgctcccagctttgggaggaggaatagacgggtgctcgtttcctcgggttcagtggcaaaggtgaagaccagcactgccgacctgggacctgggcctctcccgggcctggggaggacactggactttgaaggggaatgcagcctagaaggcctggaccctggagtcaggagatgctgctcccatccagtaagccctggctggagctcttctgggcaccaaccctggcataaaaccagtggggcctctgggcctgcactcaacagtgcctctgatggagcaggtaggagaaccccccgcaaatccaccaggcagaacagaacacgctggaggcatttaaccaggcaggcacgtctcctgcaaggagaggccagggaagggagagttcagatgcccccagctgccaggggatgcttagcggaggaagtgaggcctgagcccccctttctagcaccctctcccttcttctgttctgcttttgtatacaaccagcatgccgagggtccagttccagctctgttctgtgatcttggacaagtccgtttatctccttgggcccatttcccgcctgtgaa

SEQ ID NO: 2681 - DNA, 1875 bp, Homo sapiens
caggccagagtcccagctgtcctggactctgctgtggggaagggctgatgcaggtgtggagtcaatgtgggtgcctcctgcagccgggtgccaggaggggtggaggggccaccctgggctttgtccgggagcctggtcttcccgtccttgggctgacaggtgctgctgcctctgagccctccctgctaagagctgtgtgctgggtaaggctggtggccctttgggctccctgtccaggatttgcgctctggagggtagggcttgctgggctggggactggaggggaacgtggagctccttctgcctcctttcctgccccatgacagcaggcagatcccaggagagaagagctcaggagatgggaagaggatctgtccaggggttagacctcaagggtgacttggagttctttacggcacccatgctttctttgaggagttttgtgtttgtgggtgtggggtcggggctcacctcctcccacatccctgcccagaggtgggcagagtgggggcagtgccttgctccccctgctcgctctctgctgacctccggctccctgtgctgccccaggaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctcccagtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgggatcagccctgaactcactgtgtattctcttggagccttgggtgggcagggacggcccaggtacctgctctcttgggaagagagagggacagggacaagggcaagaggactgaggccagagcaaggccaatgtcagagacccccgggatggggcctcacacttgccacccccagaaccagctcacctggccagagtgggttcctgctggccagggtgcagccttgatgacacctgccgctgcccctcggggctggaataaaactccccacccagagtca

SEQ ID NO: 2682 - DNA, 1859 bp, Homo sapiens
  misc_feature (21)..(21): n is a, c, g, or t
tcgatctagcaggatcccctntgacaggctgatgcaggtgtggagtcaatgtgggtgcctcctgcagccgggtgccaggaggggtggaggggccaccctgggctttgtccgggagcctggtcttcccgtccttgggctgacaggtgctgctgcctctgagccctccctgctaagagctgtgtgctgggtaaggctggtggccctttgggctccctgtccaggatttgcgctctggagggtagggcttgctgggctggggactggaggggaacgtggagctccttctgcctcctttcctgccccatgacagcaggcagatcccaggagagaagagctcaggagatgggaagaggatctgtccaggggttagacctcaagggtgacttggagttctttacggcacccatgctttctttgaggagttttgtgtttgtgggtgtggggtcggggctcacctcctcccacatccctgcccagaggtgggcagagtgggggcagtgccttgctccccctgctcgctctctgctgacctccggctccctgtgctgccccaggaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctcccagtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgggatcagccctgaactcactgtgtattctcttggagccttgggtgggcagggacggcccaggtacctgctctcttgggaagagagagggacagggacaagggcaagaggactgaggccagagcaaggccaatgtcagagacccccgggatggggcctcacacttgccacccccagaaccagctcacctggccagagtgggttcctgctggccagggtgcagccttgatgacacctgccgctgcccctcggggctggaataaaactccccacccagagtca

SEQ ID NO: 2683 - DNA, 1708 bp, Homo sapiens
tccgatcaggctgatgcaggtgctgatgagtaggagaggtatcaaagatatattggccaaacccattacagtactacttggttcccggtagggcttgctgggctggggactggaggggaacgtggagctccttctgcctcctttcctgccccatgacagcaggcagatcccaggagagaagagctcaggagatgggaagaggatctgtccaggggttagacctcaagggtgacttggagttctttacggcacccatgctttctttgaggagttttgtgtttgtgggtgtggggtcggggctcacctcctcccacatccctgcccagaggtgggcagagtgggggcagtgccttgctccccctgctcgctctctgctgacctccggctccctgtgctgccccaggaccatgaatggcacctacaacacctgtggctccagcgacctcacctggcccccagcgatcaagctgggcttctacgcctacttgggcgtcctgctggtgctaggcctgctgctcaacagcctggcgctctgggtgttctgctgccgcatgcagcagtggacggagacccgcatctacatgaccaacctggcggtggccgacctctgcctgctgtgcaccttgcccttcgtgctgcactccctgcgagacacctcagacacgccgctgtgccagctctcccagggcatctacctgaccaacaggtacatgagcatcagcctggtcacggccatcgccgtggaccgctatgtggccgtgcggcacccgctgcgtgcccgcgggctgcggtcccccaggcaggctgcggccgtgtgcgcggtcctctgggtgctggtcatcggctccctggtggctcgctggctcctggggattcaggagggcggcttctgcttcaggagcacccggcacaatttcaactccatggcgttcccgctgctgggattctacctgcccctggccgtggtggtcttctgctccctgaaggtggtgactgccctggcccagaggccacccaccgacgtggggcaggcagaggccacccgcaaggctgcccgcatggtctgggccaacctcctggtgttcgtggtctgcttcctgcccctgcacgtggggctgacagtgcgcctcgcagtgggctggaacgcctgtgccctcctggagacgatccgtcgcgccctgtacataaccagcaagctctcagatgccaactgctgcctggacgccatctgctactactacatggccaaggagttccaggaggcgtctgcactggccgtggctcccagtgctaaggcccacaaaagccaggactctctgtgcgtgaccctcgcctaagaggcgtgctgtgggcgctgtgggccaggtctcgggggctccgggaggtgctgcctgccaggggaagctggaaccagtagcaaggagcccgggatcagccctgaactcactgtgtattctcttggagccttgggtgggcagggacggcccaggtacctgctctcttgggaagagagagggacagggacaagggcaagaggactgaggccagagcaaggccaatgtcagagacccccgggatggggcctcacacttgccacccccagaaccagctcacctggccagagtgggttcctgctggccagggtgcagccttgatgacacctgccgctgcccctcggggctggaataaaactccccacccagagtca

SEQ ID NO: 2684 - DNA, 509 bp, Homo sapiens
ccagccgagttattaatttcttcaccagtgttgtggtatcagcacatccagtccggtggcattcaatccatccactaaacattcagacagtaaccaaacagtgggaatgccctaaagccagaagtaaatcaacaaaatccatctggagtcctgcaaggggcagtgtgggccttggaggactccccgaggaatgttggtttcctccagagattccatgagatttataagttgtgcactgggaaacagtgtggccagaagttttgtggatgccagggtagaactaattatattttagttcctttgctatcctccatctccatatgtcccatttgataagtgcaagccaaaaggtcaaaagaaaggaagccacgggaagtctatttggtccaatgtatcatctgtctggtaattatttgctgtccttttgaattcatttgtctttttcagattgtggggcatttgcctggtaatactaacaataatcaataatatcagtcagggataaagac

SEQ ID NO: 2685 - DNA, 629 bp, Homo sapiens
ctaaagtatctgtaccctctttctctcttcttcttcacaactttaaaatatagttttagtataacttttatgtattggttattttaaaacacagtgtaatatatataagactctgtttctaggatcagctgctttattgactgccacacctttcctcccaaattgtttcccgagttatgtcatctgtcccattacttttactcttgtgaaggtttacaacatttacattttcttttgtaactatagtaaattgtaaaatcttccatgttttggctgtagattgattctaaacattaaaaaaagaatgtttatattaccatgctttttcaaattccttggaaaatctttagaatattttgctttgtaggactgaaattgttattctggatcctttgtttctgagcttcttcatcttgtgtatgtgttatgacatacatatttttgtcagacactatgactgtgacatattatgtcagacaatgtatgattgtagtaaaaaaaaaaaataaaaccttgttatgtcaaccacagggcaccctgcaaaggctcaggagtgctctgacactattccaggatttggtagggattggactatctccagcggagctgttctaatgggctgttgctgg

SEQ ID NO: 2686 - DNA, 890 bp, Homo sapiens
cttccttacaggttgtgatgagataggcaccatataggcactgatacaggcaccatatcagtctgtaggcctaccataacaaaataccacaaggtgggtggactagcaaacagaaattggtttctcacaactctggaggctagaagtccaatactgaggtgtcatcaggtttggtttttcctgaggcctctgtctttggctgcagatagccttctgctgctgtgtccttacacagccttttctttgtgagctcaagagaacctctgatgtctcttcctgtccttataaggacgccagtcctagtggattagagtgccaaccttatgacctcattaaaccttaattacttcttcaaaggccttatctccaaatacagttggtaggagcttagggcttcaccctatgtattttaggggacacaatcagcccataacattgcctaatatccacaaatcctagtttcctaagaccaaggtgtttaagcatagacagctaccttacagggatattttgcaggatactgaagccataacccatttatgcctagtgttccactattggaatgctaagcttgtggcagttatgtgtatcctgttgctcaaggtcatcaccaagttctgatttttcacacatacacacacacacacacacaaaattgcaacatttggcataaatgggttaaacagatgattgtcatatataattttaatggactctgctaacactgatattctgtcattataaaaataaaatctttggggccagacacagtagctcacacctgtaatcccagcaccttgggaggccaaggagggaggatcacttgaagacaggagtttgagacaagcttgggcccccaagcaaaaccctgtctatacaaaaaaaaaaaa

SEQ ID NO: 2687 - DNA, 650 bp, Homo sapiens
ctccagcctgggagacagagtgagactccatctcaaaagaagaagaagaggaagaagaagatcaatggaatcatttttaagaaagcaaagttagtgtgacaaagcttatttcatagacatatttaataaagagactaagataccctgattagctatagctattaaaaataaaaatatgtgactgctaaaatattaaagtcacttaaagggtgaactataagttttcaaggtaatttattcaaggaaagatagatttgcctccacttggcctatttcagcccagtaatttattttaaatacacacatgaagagataatagtattatgtttatgatttagaaagtatctttatgggccaggcgtggtggctcacacctgtaatcccagcattttgggaagcagaggcgggcggatcacctgaggtcaggagtttcagaccaccctggccaacatggcgaaaccccgtctctactaaaaatacaaaaattaaccaggtgtggtggggcatgcctgtaattccagctactcaggaggctgaggcacgagagttgctttagcccaggaggcggaagttgcagtgatgtgagattgcaccactgcaccccagcctgggcgacaagagcaaaactccatctcaaaaaagaaaaaaag

SEQ ID NO: 2688 - DNA, 527 bp, Homo sapiens
agggacattaggttggattaagtgttgccaatgctcactgtacctaccactatcttagctcctaccacattctattacaattttcagattatgtaggttatgtttttaagactttagctatccctatttggatcaccaatacctagcataaaaatgatctctcaatagataatcaatatgtatttattaaactcgattgacctgaactgctctgagaatatattgtggtgtcaggatataccctattatttaataaaaacatgtgtatgatacaatataacatgtatccaaattttaaaacccatccctcatcaggtttagtaaatggggagctttctttctcgtgctaaacaaaaacaaacaaaaaaattgaagaaagatgtttgaaaacaccctgactagtttttctttatagtagccaatccagtgaaatgaaaggatcttaaccttaaattcttttcactgaatgttttgctttatgttttatttaacaattttcattaaagatgtaaatattggaatacaat

SEQ ID NO: 2689 - DNA, 1633 bp, Homo sapiens
agagaatgtacattaaggaacaattgtcctccaaaagagagccaagcaactgctctggagcctcctaggctgactctgctggagggtgagacaagcagattcccattgcagcactggtccctggggtaccctgaacggctgtgctctccacccttgtatcggtgagtggatcttgtctacatcagccgtaagcctagaagcagagcgggatcgaggcgtttttaataattcgagttgggaagacccggatggttcatcaaaatgatggtgttgagcacccgggaggcagacattgggtatttgttcacaattttgcacctgtaagaaaatgttcctttataactttcaaggattgccgtgagcgtctttggggccttttcattcatgtacaagtttcattcattactattcaacttggtagacttggtgaaaaatgtaaaagcattctgtatttggatcagtcttgggaactaaatttgtcgtgaattggggcctgtcacagattgcctccagtgtgcatcctccacgcagaccctccttgctcagtctccctctggcgcccatggggaagccgtgctgtggttggcagtgcggccatctgggctgccgcaacgtggcagggcaccgtccagcaagactgccccttagtgcagggctaagcaaggaaaagaagaagcccaaaaaggcgggttctttttgatacttgtaattcaggcgtcctccagagtgaaggccactctgcaggcccctggtgagaacctgtctggcttttccactgcgggcccctaaccagtaccctgcccttgtggcccatttgtgcctggggcagatgtttctggccagcagacactgaaggcctttttgctgtgacagtatttatgggcactgaagaggataaagaagcttgagccctctttctgactcccactttatggggcagagagagctttttttctacatagcacattgcagtctcaccgctatcagaaaaatatcctgttcatggtttatactgaatttgcaaactactgatatgatttttcaataaccacttgtatcttccatcatccatgagaggtgggaagaggtacactgtatctctgcaataaaactttggccaggttctacctcctctgagcaaaggatacttttctatgtaggtgtagatggttctcctttactaatctgacatggtgcatctggagacaacatctgatgggatccaaagacaacttgaaacaaaggtggatgtcagctcttggtgtgttttcatttggttctcttttttaaatctcccttttgttatcgctcctgttgtagcgtgtccatcagtgtgtgaagggtgcgccctgttccaatgatactgcattgctgcatccagcctttcgtgggagcacggtaccaagcgtccggaattgattatcccaatcatttttgatatgtaactgaaaaatttggtctcatgcaataaaaatgtactggctgcattttagcaaggtttatttactcttgcaagtaaaaacgatcaaccgtgaagcgtaacaaattctgtatttagtttttttttctgttgtggtggtttttgttttgttttttgtttttgtaagattctaaataaattaaatacgagtca

SEQ ID NO: 2690 - DNA, 1558 bp, Homo sapiens
agagaatgtacattaaggaacaattgtcctccaaaagagagccaagcaactgctctggagcctcctaggctgactctgctggagggtgagacaagcagattcccattgcagcactggtccctggggtaccctgaacggctgtgctctccacccttgtatcggtgagtggatcttgtctacatcagccgtaagcctagaagcagagcgggatcgaggcgtttttaataattcgagttgggaagacccggatggttcatcaaaatgatggtgttgagcacccgggaggcagacattgggtatttgttcacaattttgcacctgtaagaaaatgttcctttataactttcaaggattgccgtgagcgtctttggggccttttcattcatgtacaagtttcattcattactattcaacttggtagacttggtgaaaaatgtaaaagcattctgtatttggatcagtcttgggaactaaatttgtcgtgaattggggcctgtcacagattgcctccagtgtgcatcctccacgcagaccctccttgctcagtctccctctggcgcccatggggaagccgtgctgtggttggcagtgcggccatctgggctgccgcaacgtggcagggcaccgtccagcaagactgccccttagtgcagggctaagcaaggaaaagaagaagcccaaaaaggcgggttctttttgatacttgtaattcaggcgtcctccagagtgaaggccactctgcaggcccctggtgagaacctgtctggcttttccactgcgggcccctaaccagtaccctgcccttgtggcccatttgtgcctggggcagatgtttctggccagcagacactgaaggcctttttgctgtgacagtatttatgggcactgaagaggataaagaagcttgagccctctttctgactcccactttatggggcagagagagctttttttctacatagcacattgcagtctcaccgctatcagaaaaatatcctgttcatggtttatactgaatttgcaaactactgatatgatttttcaataaccacttgtatcttccatcatccatgagaggtgggaagaggtacactgtatctctgcaataaaactttggccaggttctacctcctctgagcaaaggatacttttctatgtaggtgtagatggttctcctttactaatctgacatggtgcatctggagacaacatctgatgggatccaaagacaacttgaaacaaaggtggatgtcagctcttggtgtgttttcatttggttccaatgatactgcattgctgcatccagcctttcgtgggagcacggtaccaagcgtccggaattgattatcccaatcatttttgatatgtaactgaaaaatttggtctcatgcaataaaaatgtactggctgcattttagcaaggtttatttactcttgcaagtaaaaacgatcaaccgtgaagcgtaacaaattctgtatttagtttttttttctgttgtggtggtttttgttttgttttttgtttttgtaagattctaaataaattaaatacgagtca

SEQ ID NO: 2691 - DNA, 461 bp, Homo sapiens
ccatcacagtctcctcattttaacaccatgaaatgttgtcaaacaactgtccttgtgcttgctttaatatgggcagggaactaaatctaaatgtgagatttttggctaattagtttgaaatcttactgcattttcagtggttttattgatttttcatgtctactcttatgaaaaataatcacatgcaaaaggagctccttaatgaaatatataacagcgtatatttttactttcatgttcttgctattaatgtttttttaaaaaagtattcttggtattcttgaaaattgctaaaagagtagattttaagttttctcaccacaaaaaatgtatgtgaggtaacgcatatgttaattatctgtttaactgttccacagtgtatacatatttcagaacaacatgttgtacaggatgaatatatataatttttgtcaataaaaaagtcagtctcagcaaatatg

SEQ ID NO: 2692 - DNA, 381 bp, Homo sapiens
gagacgctcttgtgataccaggaacaccagctcccactggggaggagcccagcctgcaggcagagcctccaaccggcaccaaaggggacgccagccggccaggtctcgggaggaagggagggtgggtgaacaccaggaacctccacccaggggcctcggctaagccctcttctcagcggacaccctcactccaagatgtctcagcacaggggcctccccagggcagctgcagcctcaggaaggggccgtgagccccacaccccacttccttctaagcccacgccttcccgcagaccagctcctgggtcaggtcctggccagttgggaagggctgggccttgtgggttcaccagagacactgtagggtaagcagccagctga

SEQ ID NO: 2693 - DNA, 206 bp, Homo sapiens
tttttgaaagggctgttctcacatcagtgccatattttgctcttttaactgttaatggtttaatatctatataaatagcaaaaatgagcagctgttgtacctaattgcagtgtgaatactaaacattctcatagcatttgtgtgagtttgtctgttctgtctgtgatttcttgcagttcagtaaaattgtctcaaaagctttgcca

SEQ ID NO: 2694 - DNA, 309 bp, Homo sapiens
aactcaattatggattttagaaaatcagtgtcggccgggcgcagtggctcacgcctgtaatcccagcactttgggaggccgaggcgggcagatcaggagatcgagaccatcctggctaacatggtgaaaccccgtctctactaaaaaaaatacaaaaaagttagtagggcgtggtagtgggcgcctgtagtcccagctactcaggaggctgaggcaggagaatggcgtgaacccgggagttggagcttgcagttagccgagatcacgccactgcactccagcctgggcgacagagcaagactccatcta

SEQ ID NO: 2695 - DNA, 401 bp, Homo sapiens
cgcccatttttctactgccgagctttcccctcttcctccctgtcccctactcccctttttaagtcaaatgactgagttcttgcactggcatctaccccaagtgccagcatcatcacaccagaacaaaggcctcatggccacacagtgcaaacaaacagaagactctcagaatatgagggaatggccagacgtttctacttagttattttgtattatatatgatgctaatatgagtgccttggttccaaggaacatcccatggcacacaatgtcctcaagagagtctgtaagctttctgggaagctcagggttctgtccaaaatagcatcttccactcactgagccacgcactgtgccaaggcttaccctgcattatcctatgtcaccccctacccccgccc

SEQ ID NO: 2696 - DNA, 456 bp, Homo sapiens
ttgtgtggaatagatccctaaaaaggtgagctgaggatgacacacaatgagaggaaactctattacccaacacataggaagtacagtcgaatgttcccagtgggttcctctgatacgcacccaaaagcacccaaagggcataaactaccctccctggatagtggaaagtgcagtaaagacagtaacagtaaaatgggggttcctggatatccacacttcacccctctgcaactttgatcactgtgcagtagaaactgtccttaagaagatgctgaaggaggaatgcaagccgaaggtggggaagaacagaaggttctcccctcagcttctgaggccgggaatatcttgcctgcagcagatcccatctaggcaaaaggagtgatgagttgagaggtatattagtctgctctcacactgccaataaagatatacccaagaatgggtaatttataaagg

SEQ ID NO: 2697 - DNA, 433 bp, Homo sapiens
acactgtatcagtgaatgtatgtcattatacgttgtcaaaatccataaaatgtacaacaccaagagtgaaccctaatgttgggctttaggtgataatgatgagtcaatgtagtttcattgattctaacaaatcatccaccattctagtggtggatgtccatagtcggggggagacatcccctgacacctgtgagaattcattgtactttgctctttatgttgctgtaaacctaaaactcctctaaaaaacaaagttcattaacttttaaaaagtcaaacacatttatttgcctttatttgcaaattctagcctattttaataaattggtggcgggggtatctaaatagtttctttaaaataacatacatacttaggtaaaatacaagatagaatattaaaaatattcttattcttccccaaatagaagcagtc

SEQ ID NO: 2698 - DNA, 467 bp, Homo sapiens
cctacagccacgttcctcagaacactgagtccccaagactccagaggaggcaggtgttatcattccccattttgcagaagaggaaccttgagccttgagattccacgagctaaaggaactttcccaaggtcacagagctgagctgggaactgagccatggcagatttggcttcacccattaccctcaagagccccagtcaagggtaccaagaggggagacagaggaaagaagtccaggtaactgtaggtccctccctctacaaagatcctgcttccccccttcactctccacccccccgcccaagcaaacccatcctctctgcatcccaaatcccaggaagaaacccggactggcagacaatgcccagtcccggtgggcggtagagagggtggagcaagctggagagggggctggagtggggatggggggaggagctggggtcagaactcacgccctggggaggagg

SEQ ID NO: 2699 - DNA, 1591 bp, Homo sapiens
  misc_feature (716)..(716): n is a, c, g, or t
ggacattttatccttaaaaaaaagaaaaaaaaagaaaatatttaatttttaaataccaatttttagagtaagaaattggtttgatagttatctctaatagtgtcaaatgagtattttttttcctttttctcttttttgaatatcatggactttggatgttttaaaatccaatattttaccctcagttacagtcactattcattttttattgagatataattcagataccataaaattcaccttttaaaacatacaattcaacatctaaaaatgtattcacaaagttgtggaaccaccactactatctacttccagaatattcatcccctgcccccctgaaagaagccctgccctcttcagcaatcacaccccattactccttcccttcagccgcaggcaaccgctcacctgctagttctgtcttgcagatgtgcctgttctggacatttcgtataaatggaatcagacaatatgtggcctttcatgtctggcatctttcagcacagtgtttcgaggttcatgcatgtttgtagcacttcatttctaatattccattgtatggatataccacattttgtacatcagttgatggatacgtgtacgttttatatgaacagttcccatggcttttccactcaagttaggatttcttggtttaagccaggtagggtaaaaggtggagctgagtttggtgactgtgcttattgtcaaatgcngcttcttccatatgttgcagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgaggtaaatgagtccatctttatgtaaagattttcctcggagggggagaaaacatttataagcatgtaaaatttttgttgtttcctgtttcagttcggcaaaggtgtcctagaaatggccagagtttttgacagacaggttgggatgctctttctgcctatcaaggctaatttttagtccttctagactcagaaaaaccaccaaaaccctggattacattcgcctgtctgttttgtttatctagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaaaacaag

SEQ ID NO: 2700 - DNA, 384 bp, Homo sapiens
  misc_feature (54)..(54): n is a, c, g, or t
aaattcaggaaatagatatgaccgcgattatggccttagcaacggggcgagatncgagggtctctgcggtgtcgggaaatcagagggtggcctctcttctaattgatgctggggccaatgtgaatgtgaaggacagaaatggaaagacgccccttatgagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaaaacaag

SEQ ID NO: 2701 - DNA, 506 bp, Homo sapiens
tgtcacacagataaatatgagtcacaggagtttgttgtacatagtattacatcacccagaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggagggtgagagaactctgtcagttgttttttttcccccatgcctataaagtgcatagaaatacatg

SEQ ID NO: 2702 - DNA, 362 bp, Homo sapiens
atgtgagtcattgtgacatcaccagccagaattgctgggattcagtgagatgactcacagtaagagaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgtaggtgcagtgttgaattgcttgccactttgccttacttcctgattagctggaatgatttctgttgtctctaaaaagccactgcttgtttcaaattaaagaatgagtcagcatcatt

SEQ ID NO: 2703 - DNA, 1424 bp, Homo sapiens
ccctttagttctgcggcatttcgcctccgggttgtcagggcaaccgtagcgacgccggccctggctgagaggcgttaggagtccgggggttcgcccgcggaggccggggagcagccgaccatggagccccagaaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgagttcggcaaaggtgtcctagaaatggccagagtttttgacagacaggttgggatgctctttctgcctatcaaggctaatttttagtccttctagactcagaaaaaccaccaaaaccctggattacattcgcctgtctgttttgtttatctagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaaaacaag

SEQ ID NO: 2704 - DNA, 1246 bp, Homo sapiens
ccctttagttctgcggcatttcgcctccgggttgtcagggcaaccgtagcgacgccggccctggctgagaggcgttaggagtccgggggttcgcccgcggaggccggggagcagccgaccatggagccccagagggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgagttcggcaaaggtgtcctagaaatggccagagtttttgacagacaggttgggatgctctttctgcctatcaaggctaatttttagtccttctagactcagaaaaaccaccaaaaccctggattacattcgcctgtctgttttgtttatctagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaaaacaag

SEQ ID NO: 2705 - DNA, 1195 bp, Homo sapiens
ccctttagttctgcggcatttcgcctccgggttgtcagggcaaccgtagcgacgccggccctggctgagaggcgttaggagtccgggggttcgcccgcggaggccggggagcagccgaccatggagccccagaaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatgagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaaaacaag

SEQ ID NO: 2706 - DNA, 1542 bp, Homo sapiens
ccctttagttctgcggcatttcgcctccgggttgtcagggcaaccgtagcgacgccggccctggctgagaggcgttaggagtccgggggttcgcccgcggaggccggggagcagccgaccatggagccccagaggtcttgctctgtcacccaggctggagtatagtggtgcgatcatagctcagtacaccctcgaactcttggactcaagcaatcctctcacctgagcctcctggctagatgtgactacagaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgagttcggcaaaggtgtcctagaaatggccagagtttttgacagacaggttgggatgctctttctgcctatcaaggctaatttttagtccttctagactcagaaaaaccaccaaaaccctggattacattcgcctgtctgttttgtttatctagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaaaacaag

SEQ ID NO: 2707 - DNA, 1629 bp, Homo sapiens
atgtgagtcattgtgacatcaccagccagaattgctgggattcagtgagatgactcacagtaagaggtcagtgtctggttcagtagttccttcttccacatgtatccctcagtatctagaaccctgaaattggtttctctaagaaaaccaagaggcccataagggtaatgtatactgttgatttttatggttatttttcaaaaactaatattttaaacatatcaaaattatttcaaatggtaatgtactcaatgtaccatttggtttaagatgttaacattttgccatatatgtcataaagtcttttcatgaagaaatcaaaccttacaaatatactgaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgagttcggcaaaggtgtcctagaaatggccagagtttttgacagacaggttgggatgctctttctgcctatcaaggctaatttttagtccttctagactcagaaaaaccaccaaaaccctggattacattcgcctgtctgttttgtttatctagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaaaacaag

SEQ ID NO: 2708 - DNA, 1318 bp, Homo sapiens
ccctttagttctgcggcatttcgcctccgggttgtcagggcaaccgtagcgacgccggccctggctgagaggcgttaggagtccgggggttcgcccgcggaggccggggagcagccgaccatggagccccagaaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgagttcggcaaaggtgtcctagaaatggccagagtttttgacagacagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaaaacaag

SEQ ID NO: 2709 - DNA, 1583 bp, Homo sapiens
ccctttagttctgcggcatttcgcctccgggttgtcagggcaaccgtagcgacgccggccctggctgagaggcgttaggagtccgggggttcgcccgcggaggccggggagcagccgaccatggagccccagaaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtggctcacctgatgcttctgaagcccatgggaaggacttgagagccaatcaccaccttcttcccaaatgtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgaggtaaatgagtccatctttatgtaaagattttcctcggagggggagaaaacatttataagcatgtaaaatttttgttgtttcctgtttcagttcggcaaaggtgtcctagaaatggccagagtttttgacagacaggttgggatgctctttctgcctatcaaggctaatttttagtccttctagactcagaaaaaccaccaaaaccctggattacattcgcctgtctgttttgtttatctagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaaaacaag

SEQ ID NO: 2710 - DNA, 1479 bp, Homo sapiens
atgtgagtcattgtgacatcaccagccagaattgctgggattcagtgagatgactcacagtaagaggtcagtgtctggttcagtagttccttcttccacatgtatccctcagtatctagaaccctgaaattggtttctctaagaaaaccaagaggcccataaggaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgaggtaaatgagtccatctttatgtaaagattttcctcggagggggagaaaacatttataagcatgtaaaatttttgttgtttcctgtttcagttcggcaaaggtgtcctagaaatggccagagtttttgacagacaggttgggatgctctttctgcctatcaaggctaatttttagtccttctagactcagaaaaaccaccaaaaccctggattacattcgcctgtctgttttgtttatctagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaaaacaag

SEQ ID NO: 2711 - DNA, 926 bp, Homo sapiens
ccctttagttctgcggcatttcgcctccgggttgtcagggcaaccgtagcgacgccggccctggctgagaggcgttaggagtccgggggttcgcccgcggaggccggggagcagccgaccatggagccccagaaaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgatctcgtgttgctatggctgtggtgtaggtcagcggctgcagctgcaattcgacccttgcctgggaacctctatatgccgcaggtacagccctaaaaaagaaaagaaaagaaactttggcagagacagtga

SEQ ID NO: 2712 - DNA, 423 bp, Homo sapiens
ttctttgtctctgagagttagcttcactttgtcagcctgcttctttatactcttcctgtttttcactctgacttactgtgtttataattatcttgggttagtttttcttattgctcatttggaaaaactatcagtacttctgattagtaatttcagatgtttttatattttaattttgtatgcaaaataagtatccgtgatattttaaaaatatttactaagtatttccctagtctttctctaaagggtaatctcaaatgaaacaactggaactggattctcatttgtttaatgactgaagaagtcttccaattactctacaaaccattgataacttttgttatttgtgaccagtattcatctagtaagatgttaaatgcttttatgaaagagacaagtgttttacctaaagaatgagaaaaa

SEQ ID NO: 2713 - DNA, 365 bp, Homo sapiens
atggcaggacagcctgaattagaggttatgtagtctgactttgcatcagcattactgacagaacatgtcaaagatacagattacttcctagaaattccaatttagtaggactgaggaggaatcagagaacttctacttttgggggttgtctggggcataatcccctgttaatacctgttctaacatccaataattccaagtggctggaaaattgttttggaacttacaacaacttgtcattctaaacaacatcccagtgggaagcatcagtgatgttcaagctagtgcctgccttcagtccatcactgagggcatgtagggtgctgagctgcaggcataggcaagtggccaggtatgtagaggtg

SEQ ID NO: 2714 - DNA, 469 bp, Homo sapiens
ataagctaccacacttggccatgagtcatttttaaaaaaacagattccaacaacctttttgattgctgtgtttagaagatttatatttaattttggacgggtttttattatctattttctacttgttccctctgggtttttttatacctgtttcccttttcttgcctttttatggggtacttagacatttcttagtatgccatttaacttcatatgccgtgctaaatcaattcagtatgccatttagtatatatttttgtataggattttataggtggctgtagagattatattatacatacttatgatcattggctagtatcaaccttttaccaattcaagtggaatgtagaaactctactgctttctaggcccctctgcccttctttatggtattgttgtcttgaatatcacctctacattcattgagaaccactgagataatgttatggttttgcttttgcccatc

SEQ ID NO: 2715 - DNA, 322 bp, Homo sapiens
gcagcaacagttctcaaatttattattttagctgttgtgaatatgacttttgttagattcagcataaacagcaaggtatgtagtgatttcactaggggagtaaatgctatccaagagtgctattttcctaaatgaattaagttgcaagaaacaaattacatagtgtcccaaagatttaaaaatagagggaactccataaataacagggaggttagtaatagataacctcattctctggcttaaaccataaaggaaataaattggctcaaaggattgtaccctccagaggttagtcatggcttcagcatgatttcattagact

SEQ ID NO: 2716 - DNA, 350 bp, Homo sapiens
ggttgggaagtttcaggagtgaatatcagctgaggtggggatgccctggctcccaacacaattagcttcattctgctacagttgggggttttcttatcattagtcgggaaggcctagccagagaattccagtattccagagcaagtttaattgtgggtgatttcattctgccctttttatgtcgcagccaggggcttgcgtcatataacagtgaattcagggagatttttatttgcatgtgaatcatagcttttccagctgaatgtcacttacttggaatttttgtctgattttgtttttgtttttgtctcttggtgtttttccatcgggctctttggctaaccagaaaa

SEQ ID NO: 2717 - DNA, 346 bp, Homo sapiens
cccattcctgcacttacaacagacactgatcatcagtcacagcactttgccccttgagcacagtcagagccctccctttcagacttctatacagtcattttcaataaactggagatagtacatgagataaaacctatttgccatcctacatatccttaagcaagatgtgaatttcattacaattcaaagactttcttagtgaatagtgcctacataaacagctttttaaaaaactctgggccgggtgctgtggctggctgggtgctgtggctcacacctgtaatcccgaggtgggtggatcacctgaggtcaggagttccagagcagcctggccaacatggcgaaa

SEQ ID NO: 2718 - DNA, 794 bp, Homo sapiens
ataataacataatgaaagccatatctccatgatatatatgtgcacatatatatacatacatgtgcatgtatgtatcatattaaggacccatggtactcttaaaacactgtagaactctgtgacgcagtaaggaaggggcagatttgtacaaaaacttttctagattccatcagcaaaaaccaacacaggtttgtcacgctgcatgtctggccagctaatctcgggggaaaagctacaagttatttattttattttaagagaataaagtaggtaataatttaagggatcaaattcaaggaggaatgtgcaattttagagcaaagatttgtttaaggcaaatgagactttgggagcatcccattccagttttgtcttttttttctctgaaagaaaaaagcaaaaaataaaataaaattccacttataccttctgacaagtccctaaaggtcttgaaataaaaggttctatgcaagtgcaaagttttatagttatttttattgctgattattactattactatctctgttgtcttaagagtatgtgctgatttcagagacatctcaaattgaaagaatatcagattgcttttaaagtagctgaacgagccacagaatatctgaaattattcattgttgttcctccaccaccccctttctcatggtctgatttttagaagagtggcatcctcgttctaaaatgtaatgatcaccaaatacggccttccatcaaatttgtgaaaactacaacagtataacagtgacaaacctaattctctagcccaaacctggtctgac

SEQ ID NO: 2719 - DNA, 427 bp, Homo sapiens
acaatagtaactgcttattgtttaagccattgagatttgaggtagtttgttacacagtaataggtgtgataaatatttcaaactttgtaccctacagaaaatacctattctttttaaatggctgtaaaaatttatgaaattgattctagggttatcataaaggaaccttaatagattctttcaaatagaaactatataaataactttttaaaatcatactgccttaaaactagaaatttgttcctttttaaaaaaagtttaaatataattcaagctacttgataattgaacactcctaactcttggttctttgggggaaaaaggatcattaaagtggacgtgacctatgaattcaatcaaatacaaatgaaaaaattcaatgtgggaaaagggcatacagagaagattgagaatcctatgtagttaa

SEQ ID NO: 2720 - DNA, 458 bp, Homo sapiens
ttgcgtagaatccctaatggtcttagtgcaaaggtctcacagttctttcagagtggtttctcaggtttccttagctggagggagatcagtgcattttcagatgtcagagctggtgctgacaatggagccaaacttggcttttcggaactgaaagtatgcctaatccttaaattccttttggagggtaagaaaggaaggctgaaaggacatcaggaattggagggtaagaaaggaaggctgaaaggacatcaggaattggagggtaagaaaggaaggctgaaaggacatcaggagttgaggtcttgtgtttggtgattggccatgttgcttttcttctgctttagcaagtcgacatttgaacagtaacagagtgtcttaagcaggcttctctaataacttttcatctgtcttgttgggagactgtcagggtgtcaagcttttagaaaaccatacagcac

SEQ ID NO: 2721 - DNA, 504 bp, Homo sapiens
ttgactacggctgcagaagtgttcctttagacaaagttgtgacccattttactctgaataagggcagaaacggttcacatttcattatttgtaaagttacctgctgttagctttcatcatttttattacactcattttatttgtatttaaatgttttaggcaacctaagaacaaatgtaaaagtaaagatgcaggaaaaacgaattgcttggtgttcattactacatgtatatcaagcacagcagtaaaacaacaacaacaaaaaaaaaacatgtatttaactttttttaggtttttttgcttttgtggtttttcttgatacttgcctaacatgcgtgtgctgtaaaaatagttaacagggaaataacttgagatgatggctagctttgtttaatgtcttatgaaattttcaagaacagtccaagcacaattgttaagaacatgtgtattaaattcatgtcagtggaataaaagttttatgaatgcacttttcaactactttct

SEQ ID NO: 2722 - DNA, 501 bp, Homo sapiens
ccatggggagaagggcaaagtgaacagggccacgccttctcgaggagagtgtgtaggccgggctcagtgctggtctaaaggacttctcagaactctccttctctgtccacctgactttctgggctgaggggccacctgaagatgagtctgccctgcctccaagaggtgtcctggagtctgagacctctcatggttactctggaaaagaatgagcactcctttagacctggtccacctgcggcctgtcctgggccaggagctgcccctgcacccttttggagagggaagccagggaccagaccatgctctagggccacacctaccacatggtacagggggacagaaagggtccagtgaaagtgaagtcagccttgacaagcagaaaatgatgtggctcaaacagcagaatccctgtgcatgcagcaggtctgctttataaaacacaagactgagctatttccattagcagccgttctatgtagccctgaacatttttatgca

SEQ ID NO: 2723 - DNA, 294 bp, Homo sapiens
aagcagtgagccttggcgacctgcacatgctgcttattctgcaggcacacagcaagagctgtgaggcatagcagcttccacctagatttcaaaggatgtatcagacagcttgtgggcccacgcagagacttactgcaagggcacaaccactgcagagaacccctctgctagggcaatgctgagtggaaatgtgggaccagagctgctgcagaaagttcccaacagagcagtgcactctggagccgcaggggcaggaccaccctgggacctcagaactgtagagctaccagtatg

SEQ ID NO: 2724 - DNA, 475 bp, Homo sapiens
tcggggatgccaaacacctctatttactcttgttactccagggcgcaccattccaataaaaaacaacattctgaggctgaaaaaacaaaagtgccctgaacgccagccctaagtaaacatcaggggagaagagcagctccgcaggaaggccccatcccggcactgggactgcagcccatccacgaagaactccagcagggctaagaggacagtgtggaggccagacacacccgagtgcaaacagaatgcagaagagcttgcattccagtcaggaagacaacagtcctcagacggggcaaggatggaaagaggacactctagacgttaatgctaaaatgttaatagctaacatttattgcagactgtttgtttccggtgctcttcaagcactttgcattcgtaatgttcacaacagctctatgaggtaggtgctttaggaaggagggaatggaggctccgagaggttaagctactt

SEQ ID NO: 2725 - DNA, 826 bp, Homo sapiens
tgatggcaggcgcctgtaatcctagctacttaggagctgaggcaggagaatcacttgaaaacaggaggcagaggttgcactgagctgagatctctccagtgcactccagcctgggcgacagagcaagcctctgatctcaaaatctcatctcaaagcttggctctgacaccttaacagtcctgtgaccttgggaaaggtacttaactcagagttgtagggattaatgagataacatctggaatgcactccttttccgccctcctcctctttcttcagatcgtccctaacctcccagcttgcccctctgctcttatcacatactgtattgtagcttttatcgtaacaatagttataataacaataaatataactacatgtttggtaatttttcttaatgtgtctggtacctgtctcatctgacagtaaggagcatgtaaacaggattgtgtcttcgaaatgcctagcacttagtgggcattaatgagtatttgctgtatgaatgaatggcagatattaaagtgcctagcccagtattagtggagtttcatctcccctcaccaagtgagaggatgtcagatttttcttacatacacattttctctccccaaataattctcattgtaagcctcactacagtttttatgaaatacctacagaggcagggcatggtggctcacacctgtggtcccagcactttgggaggctaaggcgggcgggatcatgaggtcaggagatcgagaccatcctggctaacacagtgaaaccccatctctaataaaaatacaaaaaattagccaggtgtggtggcgcatgcctgtagtcccag

SEQ ID NO: 2726 - DNA, 342 bp, Homo sapiens
agtgggggagacctcagctttgtaaactcctgtggccctgggtgaccaaacccacaagggctctcagcttcctgtggggaggggctgggaaggcaagtggtccctggggatggagagcactgaggtcatcagtcccttttacctctgcagagggcaaagagagtcccaaagcacagagctgtgcccggttgggggtcaccagagctaggcactctgggggccaaggggtggaaggaggagctggagcaggcgttgaggaagagttagaccctgtggctgtgggcagccagctcccaaaagctaagactagagctacagtagcaggaactgaaattaaactat

SEQ ID NO: 2727 - DNA, 465 bp, Homo sapiens
gtcaccgggcaagcagcgcacgctgtgggcagacactgtcccaagtcttagcctgcgtgaactcactggcgccacaaccccatcgcggttttgtgatcacccctattctacaggaaactaagacacagagaggacaagtcacttgaccaaagtcactgagctggctgggcgcaatggctcacgcctgtaattccagcactttgggaggccgaggcgggtggatcacctgaggtcaggagttcgagaccagcctgaccaacatggtgaaaccccgtctctactaataatacaaaattagccgggcatggtgctgggcacctgtcatccaggctactcgggaggttgaggcgggagaatcacttgaacccaggaggtggaggttgcagtgagccgagatcacatcattgcactccagcctgggcaacaagagtgaaactttgtctcaaaaaaaaccaaaaaaacaac

SEQ ID NO: 2728 - DNA, 458 bp, Homo sapiens
aaatcgctgttcttgttgtttttagatctttgtagtcataattgtccattatgtttaacagcactggagattttgcaagtggaattgggtagatctgttaaggacattcagtcctgtcttctgccaggcattagggtctcttctagcatgtttcactcaatttctccagccaagaaatgtagggttattctttggaaaggggattgtgataagttaggatattttggttgtaagcttcagaatcccatttcaaagttgcataggcaacaagagatatgttgccacccataactgtaacagtcaggggtattcctgggctgggggcaggatgctgcctggactgtgtctcccccgcatgggtatttgattctctataacccaaaccagatttccccatgcaggcagcaacatggcagttggaagctccaggctcccttcttcccggctttgatagcaga

SEQ ID NO: 2729 - DNA, 414 bp, Homo sapiens
accccccccaccctgcctctctcctgtctttctctgtcttccttcccttctcctctccctccctccttctctacttgatttgactctcttactgtcttcctttctgcctccctgtcttcttcccctccttccctgctctctttctcattttagtgagtcactgccttggtccattcatggagccggggccaggggatagatagaaagatgcattaagacacacccttgccctctaggtcctagagaagagatcagggtgcatggggagatcagaatgtgaatagctcattgctacacaggctttccctatcatttggacagtctttctctttcacttaatgaatgaaactgaagggttgttggaggcccaggcttccagtattgaattgacgttggatcctgggaattaaaaaa

SEQ ID NO: 2730 - DNA, 426 bp, Homo sapiens
agtacaaccaactctctaccaaattagggacaaatgctccccggcacaggagcttttgttgttgtttaaagctaatcttaggaatgaccaacataaacagtgtgtgttttccacatgttaggcaatgttctaagtgatttacagccctctaacaaccgtgaaatattaatactattattttctccattttatatgaattaactgggacatagagaagtgacgcagtgtgcccaagttaacacaactgggaagtggaaaagctgttcaggtcctctgtctccagagcccagctcttgctcataacaccttttctacctctcttaaaccagtttattgagtgcctaattggtcctcttagttactttatatgatttatatctaatcctcccaacaatttcctaagcacagctgattatcccctttgag

SEQ ID NO: 2731 - DNA, 266 bp, Homo sapiens
cgaactgtgagttaaacattgaatgacaatatcttgcaaacatccctggaaacttatttttcttctagcaaaaataacaacaatgatattaatggctaagctgtctgtggtgaccctgcctgtaatcccagctactcgggagactgaggcaggaggatcacttgagcccaggaggctgaggcaggagaattgcttgaatgcaggaggcggaggttgcagtgagccgagatcaggccattgcactccagcctgagcagcagagtgag

SEQ ID NO: 2732 - DNA, 329 bp, Homo sapiens
ttttttttttgctaaggagtccggcttacaggaagtgctcaatgttttatttggggaccaggacttaacagggtgaatctggtatgtttggtcaacctcaggatgcaacctaatttttcttcctgactatgatatgccatgaatgtgatgattttcctttcagatgtattgcttataaaataaagaagttaagaactttgtaaggaaaaaagaagaaaagccaaagatatgaacaattgtaagacatatttcaatgtgagaaatattaaaatgtaaataactaacaactcagcatcaataaaatattatttactggccgggcacggtgg

SEQ ID NO: 2733 - DNA, 619 bp, Homo sapiens
aaagagatatagctacaggtaaactagattgaatctgctgtttatgtgttggaagatgacgtttgaagatgagttttagttcttagcaccaatacaacaaatgatgggatttgaggtttaagtgcctaagtttaaggctctcatataataactcttaatttctttttgtgtcgggaaaagaacaaactcttgccttgaattaaccagttattttaaaaaatcatagacttctgtcattagaggaaacggcctgaactccattaccaggtgactttttagctttagtgggtggcacatgggactgtctgtggtgtgccatctgcagtgcgcaagccatttgtttctggaaacagtctcacaagcaatgattctggtgagtttagaaatgaatcaggatgtgctaagctcaatgaggactcattagccttggataatgtgattctataaatgaacagaatggagacggtgaagactcaggagtatagagaaaataggatgacactggaagctaggctgattggtgggagttttggaatcaatgtgcttcaactattagttgattaagcatatagttgaattagtaaagagtgggagacttgccccttgactgtgtgttatt

SEQ ID NO: 2734 - DNA, 406 bp, Homo sapiens
taaaatgtattgcaaaaataggcaaattgtttaattttttctcttgttctctgcttgatcctggcataagccatgttctccaacacactctccacgtctccacctccctagcccagcacgaggccccaacaacatatgtgcacgtactctgacagtgggtggagatgttaagcaaaagcaaagaaaaaaaaatcagtttggacggctggggaaagagatttgggagtcacgggtatatatgagtaaaagtgaacaaaccaggctactttccatgtgcctgctggtcctcttgctattgtgttttcattagccaaacacactttgcaatatgtattaacagacttaataatgccttgctgttgggggatgtgcattatttcaaatgttctgttttgagaataaggaa

SEQ ID NO: 2735 - DNA, 410 bp, Homo sapiens
ccatgttggtcaagctggtctcaaactcctgacctcaggtgatccgcccacctcggcctcccaaagtgttgagattacaggcgtgagccaccgtgcctggcctagaaattttctttattgctatttgaatgctctactcatacttctaagaaaaaaaaagtttattcctttgaacttcataaacagagcttataaatagtcttctctggtaactgtatctaaatatctcacctttccctgtggatctggaaattttccatcagggaatttagctataccaagttttccatcacctctgagaacatcagtgtactccatttgtgtataaccatgggcaaacctctgtaaaatgtgaatttatctttgaaacaggccaaatcttgaaaaacccaaagaaccaacttatccct

SEQ ID NO: 2736 - DNA, 347 bp, Homo sapiens
agatattctcaaatggggttgatataagttggaggtggaagaaggaagcattgctctgaaagtgctggtaccaaaacttactctgtgaagaaaaacaggacttcggcaggatttgactcagaatagagagttctgctatttgttctttaattggctgctgttaaacacttcttcattgtgcttatgagtttagcatgttaatgcttacatgtaaaaactaattgcttaaaatgctggttctgaaattaatcacctaatgcactctttattaagaaggttaaggagagagtctttgacaatgattctagagtctcaaagggaacaaagagtttaaatggaaggacaat

SEQ ID NO: 2737 - DNA, 437 bp, Homo sapiens
aaagaagaatcatcaaagggctgggcatttccttccaagcactctcccccagggactgcccactgggacctctcacctctaacgattctgccttagttggtctggggtgccgcctggacatctgtgttttcagaaagttcccaggacattctaatgggcatccagggtgcgaacttactgagctggtctaaaccatcagttggcagatgaggagatggaggctgtgatttattttaaactatagcccttcatttaaattcctgtcggcctcctcaggaggtttggctaacacagaaatctccagtattctaaaatggagaaacggtgcggtggctcacgccgttgatcgcagcactttgggaagccgaggcgagagatcgcttgaggtcaggagtttgagaccatcctggacaatgtggtaaaaccccatctctatt

SEQ ID NO: 2738 - DNA, 3588 bp, Homo sapiens
agcgggtcgtgcctgtcagcaggggcagagtagcgatcgtcgccaaagcgcgcggttttatttctctccgctttggacggggcaaactagcttttgggagtgaagcgggtacgcagttatccaacaatgtctggtgagtcaggacagcctgaggctggtccctcacatgcagggctagattggccgaaccctgagaggaatcgggctggggtcccgggaggggtgatccgaagagctggttcccaagggcccaggtcctggatccaaaaggttcttgagcagattatggactcacctcgccagtgtgtcaccccctcggaggtggtgcctgtaactgtgctggccgtccagaggtacctgttagaggatgagccacgcgacacggtgcccaagcctcccctttattgctatgatgtgacgatctcagatggggtgtaccaggagaagtgctacctggaccccagcttgaactctctcgtatatcaaaatattcttaaagttggcattcaaatgagaatttccagggtctcatgtctttacaatgagaaaaggataggccaggggatcctgtgcatagataacgtccactgtggggagacttcagacagtatttctttagaaactcccttcagaaatagagcgcaccaggagaaaccagagaggcctttaagaggcgggaagagtcattacctggcgctgtggaataacgaagatccctatggagatatctggttaacagacaagcaacctgaggaacacaactttagcgataccaaaataatttccctttctcatcttgaaatgacctggactaacagaagaaattttcctgcattgcttgtgaggatcttacataaatcaaaactgcgatactatggaaaacctgataaaaagatgattgaaccatatcagacctttttggaagttgctgacagttcaggcacagtgtcagtgattatgtggaatgccctgtgtcctgagtggtataaaagtttgcgggttggtttagttcttctgcttcaagactattctgttaaaaagagttatccattcagaatacagcctgtccccgtggatccacagatcaaactaatttctacaatggaaatctgcctgaatcttcgagatcccccaacaaatataattatcattccagaaaagcaggtgaaaccagaatggagactgccaaagctaaatcaccgatttaccacaaggtcagaactggatgatatgccagaaaattgcatctgtgatgttattggccttttagtttttgtaggaagggtccagcggtcaaaaaagaaagaaaaccgtgaagatttttggtcatatcgctggattcacattgctgacggtacttcagaacaaccatttatagtggaactgttttcaacatcgcagccagaaatctttgaaaatatttacccaatggcatattttgtgtgtacacagttgaaagttgtcagaaatgacaatcaagtacctaagctgctttacctcaccactacaaatgagagtggagtgtttattactggtcatagaggccagccgtatacgtatgatgccaagaatgctaacagaccctcgacctctcaagcagctagagtagaaattcaagaaagaaatggtaaacggcatcaagatgatgagcctgtgaattctcagtatttccaaactacatctacaaatttaagtctgagcaataaaataagaattcttcaaggcccacacgctaatccagttgctgtacctcaaccaggagcttctgtacaaacaaagggaattaaaccgggcatgccaagcatcttcaaccgtcgagcaaatataaatgctaatctgcaagggaaagccagaaaaactataagtgataggtgggagagtcagctgtggagagagaaaaagtttggcttaatagatcacctacactacagccgtgtttatcctgaaagtattccacggaaatttatgtttgaacacagaaagtttcttagtgaccagtataattctcagcctgcgaaatatgtaccaccagaaggaaggcccccaaaacttgatgattttaagagcgcccgaagccttggacattttgaagtaaccatactaggtctgaaccatgagatagcaatcgatgttgctttcctacccatgtattgtccagaagatattcgaacatctcaaatagacacactgttgacctccatgaattacagctgtgcatatccacaggacacaactggaaatgaccgattgccaggtccaagagcggttgcaggtgatattataaaagcagcaactgaactggatagagtgcatatcgtcggtatcttggatatctgtaatttgggtaataataaagtggaagtctatttgcacaagatttatagtccagagaatacttcttaaaagttagcaaatgaaattattacagattatacgagtgtactgctttaaagatattccatcattttgctggtaatttcagtaactgttttcagcaagaatattacatgagctctaaagttattaagcagttttatgttcgttttgtgtttagggagctttttaaaacacttcatttcagattcattattgaaaaaggtcatcaaaataatttttgtgtataagggaatttaccttgcttaccttactagtatgactattatcttgacttctggtaatttatgttcactattccatttgtgaagtgtactttcattctaaagcctcagtataaggcatcctaacttacaagagtaactttccatggacatttaacatccttccaattttattcacatataatgggaaattttgaattgccagtttgaagactgttctcctaaagtgttcaacctgcacttcttacaaccaaggtagtttgtatcattttcaaaagtacacattattagggtctagttgcccctggtccttagcttgctcagctgcaaaataagcgtgctaaattaaattgtcttaaggtttttccacttcattttgtgactttgtgtggttcgaatttctcagtattttaaccagtgtgttgatgttaaagtcaaaggctgcagtatgtctatattcttgctgtactcattggtagtttcagtatatgtaatgtgagtttaaatagtgaaattgtatctcatattaacatttcaaatgctcatattgaaaatggaaaatagtaaacacgggaattgattttattctggttgtctataatacttcattttaaatgtaaatggccactctgcatttgcaaggcccggtggttgacatctgtgtggtttgttagatgagacaaaatgaccattaaatgagtttatagattattctgtatcaagataaatctgattccagttaagctataaacttgtgggattttcttgtagccctatagttctgtgacttcatttgctatacgctttaaatgtgttgagcagcctatgaacctaaagacatactgcagtttgttcataaatgtattcagtcttttattctttataattgtgtgtaaatgttaactaaacagtggattcctctcgtgttacagttttgagtgaattattaaagaagttaaaatgcaataac

SEQ ID NO: 2739 - DNA, 2318 bp, Homo sapiens
agcgggtcgtgcctgtcagcaggggcagagtagcgatcgtcgccaaagcgcgcggttttatttctctccgctttggacggggcaaactagcttttgggagtgaagcgggtacgcagttatccaacaatgtctggtgagtcaggacagcctgaggctggtccctcacatgcagggctagattggccgaaccctgagaggaatcgggctggggtcccgggaggggtgatccgaagagctggttcccaagggcccaggtcctggatccaaaaggttcttgagcagattatggactcacctcgccagtgtgtcaccccctcggaggtggtgcctgtaactgtgctggccgtccagaggtacctgttagaggatgagccacgcgacacggtgcccaagcctcccctttattgctatgatgtgacgatctcagatggggtgtaccaggagaagtgctacctggaccccagcttgaactctctcgtatatcaaaatattcttaaagttggcattcaaatgagaatttccagggtctcatgtctttacaatgagaaaaggataggccaggggatcctgtgcatagataacgtccactgtggggagacttcagacagtatttctttagaaactcccttcagaaatagagcgcaccaggagaaaccagagaggcctttaagaggcgggaagagtcattacctggcgctgtggaataacgaagatccctatggagatatctggttaacagacaagcaacctgaggaacacaactttagcgataccaaaataatttccctttctcatcttgaaatgacctggactaacagaagaaattttcctgcattgcttgtgaggatcttacataaatcaaaactgcgatactatggaaaacctgataaaaagatgattgaaccatatcagacctttttggaagttgctgacagttcaggcacagtgtcagtgattatgtggaatgccctgtgtcctgagtggtataaaagtttgcgggttggtttagttcttctgcttcaagactattctgttaaaaagagttatccattcagaatacagcctgtccccgtggatccacagatcaaactaatttctacaatggaaatctgcctgaatcttcgagatcccccaacaaatataattatcattccagaaaagcaggtgaaaccagaatggagactgccaaagctaaatcaccgatttaccacaaggtcagaactggatgatatgccagaaaattgcatctgtgatgttattggccttttagtttttgtaggaagggtccagcggtcaaaaaagaaagaaaaccgtgaagatttttggtcatatcgctggattcacattgctgacggtacttcagaacaaccatttatagtggaactgttttcaacatcgcagccagaaatctttgaaaatatttacccaatggcatattttgtgtgtacacagttgaaagttgtcagaaatgacaatcaagtacctaagctgctttacctcaccactacaaatgagagtggagtgtttattactggtcatagaggccagccgtatacgtatgatgccaaggtaaaaaactttattcaatggattagaacaaagtctgattccggggaacagaagaatatggttattggtggatattacccctatccaccagtgccagagacattttccaagtatagtagttctattaaaggtactaatgtaattgccagtccttctaaatatgtttatattttatatgtatggcttatgctatttcaattagtcatctttattcttttcttttatgggagtgatctaaagtttagcaacattcaccgataatagctttgtcttaatgcagatctaaaaatatatgtcacgtattttctatatagttttccctatatctcgcatggtgctctaaagattaatactttgatttttatcagactggaagaaaagagaaaacacagatgataaccaactggagatataggttgagtattcctaatccaaaaatccgaaatctgaaatgttccaaaacctgaaacttcttttttttttttgagacggagtctcgctctgtcgcccaggctggagtgcagtggcgggatctcggctcactgcaagctccgcctcccgggttcacgccattctcctgcctcggcctcccaaagtgctgggattacaggcgtgagccaccgcgcccggcctaacctgaaacttcttgagtactgaagtgacactcaaagaactactcattggagcagttcagattttggaattttgcattagggaagctgaactgataagtataatacaaatattcc

SEQ ID NO: 2740 - DNA, 2419 bp, Homo sapiens
tttttttttattttgcaaatgaggggtacagagtggaagcctgtattcaaatttaactgataaaagtattttgcctatttcacaaaattatatagaaggatgccagatataaacacagtgtctcacagttaatgtagtaagtttataattttgtgttgtgaaattacattgcaaatctaattcttatttttatcatttcagttctttaaaacttacaattttcttggacttttttgcagttgagtcgctcttgacagctataagtgaagtcaggaaggagattgaagacttgcagtatagggaacaaaagcgcattgcaattcaggggataattactgctataaagtatatcccccatagcagtgcgactgaaagtgcctcagcatcagaaacacttcggaatgctaacagaccctcgacctctcaagcagctagagtagaaattcaagaaagaaatggtaaacggcatcaagatgatgagcctgtgaattctcagtatttccaaactacatctacaaatttaagtctgagcaataaaataagaattcttcaaggcccacacgctaatccagttgctgtacctcaaccaggagcttctgtacaaacaaagggaattaaaccgggcatgccaagcatcttcaaccgtcgagcaaatataaatgctaatctgcaagggaaagccagaaaaactataagtgataggtgggagagtcagctgtggagagagaaaaagtttggcttaatagatcacctacactacagccgtgtttatcctgaaagtattccacggaaatttatgtttgaacacagaaagtttcttagtgaccagtataattctcagcctgcgaaatatgtaccaccagaaggaaggcccccaaaacttgatgattttaagagcgcccgaagccttggacattttgaagtaaccatactaggtctgaaccatgagatagcaatcgatgttgctttcctacccatgtattgtccagaagatattcgaacatctcaaatagacacactgttgacctccatgaattacagctgtgcatatccacaggacacaactggaaatgaccgattgccaggtccaagagcggttgcaggtgatattataaaagcagcaactgaactggatagagtgcatatcgtcggtatcttggatatctgtaatttgggtaataataaagtggaagtctatttgcacaagatttatagtccagagaatacttcttaaaagttagcaaatgaaattattacagattatacgagtgtactgctttaaagatattccatcattttgctggtaatttcagtaactgttttcagcaagaatattacatgagctctaaagttattaagcagttttatgttcgttttgtgtttagggagctttttaaaacacttcatttcagattcattattgaaaaaggtcatcaaaataatttttgtgtataagggaatttaccttgcttaccttactagtatgactattatcttgacttctggtaatttatgttcactattccatttgtgaagtgtactttcattctaaagcctcagtataaggcatcctaacttacaagagtaactttccatggacatttaacatccttccaattttattcacatataatgggaaattttgaattgccagtttgaagactgttctcctaaagtgttcaacctgcacttcttacaaccaaggtagtttgtatcattttcaaaagtacacattattagggtctagttgcccctggtccttagcttgctcagctgcaaaataagcgtgctaaattaaattgtcttaaggtttttccacttcattttgtgactttgtgtggttcgaatttctcagtattttaaccagtgtgttgatgttaaagtcaaaggctgcagtatgtctatattcttgctgtactcattggtagtttcagtatatgtaatgtgagtttaaatagtgaaattgtatctcatattaacatttcaaatgctcatattgaaaatggaaaatagtaaacacgggaattgattttattctggttgtctataatacttcattttaaatgtaaatggccactctgcatttgcaaggcccggtggttgacatctgtgtggtttgttagatgagacaaaatgaccattaaatgagtttatagattattctgtatcaagataaatctgattccagttaagctataaacttgtgggattttcttgtagccctatagttctgtgacttcatttgctatacgctttaaatgtgttgagcagcctatgaacctaaagacatactgcagtttgttcataaatgtattcagtcttttattctttataattgtgtgtaaatgttaactaaacagtggattcctctcgtgttacagttttgagtgaattattaaagaagttaaaatgcaataac

SEQ ID NO: 2741 - DNA, 300 bp, Homo sapiens
cccatcattccttttacattactgtctcctacatgaacagatctggactcttgggctgcagagaaaggaaagcattcattcagcgttcattccactaacatggactaagcaccttccacgagcctggcactgggggcagactcagagattgtagtttcatgggggaggcagagcagtaaaaaaaagaaattacagtatagtgtggcaagtgctattttctcagctgtaaaaagatataatagtggtacttacctcaaggattacaataagaaataaataagttagtatttgtaaactgct

SEQ ID NO: 2742 - DNA, 453 bp, Homo sapiens
ctcttacactgcacacattataaagcatttcatgctctttaaaactgttatacagcctttttactcgaaggtaataaacctacagctctctcctggcgagaaagagattccattttgcggaaacagattccagtcaaaatcttaccacattcccctcaactatgggtatgagcctaaaccaatgagaagctccttggtgcatgtgtaatggtctccaagaattacaacaacatcctacccggaggaccacaaccacgacaccactggctttaaaatcaaagcctggtccctagcgaagaaagcgctttaatgtgctcctcccgctcccgggtgcgagattcctgcccagctactaggccacgactgaaagcacaactgctgtagggggaaaacgcaacagcgccatcgcgaataacagcgaagaggaacagcgggaaaacacaaggggcggcc

SEQ ID NO: 2743 - DNA, 217 bp, Homo sapiens
atagtttgaggtcttacatttaaatctttaatctatctattgttaatttttgaaaggtatgatccagtttcattcttccacatgttgctagctagccatcccaacactattgaatagggagtcctttccccattgcttttttgttgttgttgattttcttgaatataagatggttgtgcagctttatatctggtttttctattctattcccattggt

SEQ ID NO: 2744 - DNA, 2545 bp, Homo sapiens
cgatttgtaaaacctccgtgtccccgcgcgtttttatatatggtgggaaacaccagccgcattttcggcccaggtttctttgggacaccggctatgcacactggtgcaccataaccacaatgcggcccggcgccccaccaagagtgttgtaaaaaacgttcttctcggcgtccgatgcgcgtccgcaacacgttttttgttgatgagttagttgacgttgctcttcttggactgaagatggggtctccctatgttgcccaggctggtcttgagctcctgggctcaagaaatccttccacctcgggctcccaaagtgctgagattacagggtgtgagctaccgcacccagccatgaaaacttctgtaaatcttaactatcgtgttctgcttaaagtgaggtacacataaagtttcctgtgctttgtttttgtaggaaaaagtacatagtttgtatctttaccttacggagtctatgagatttgagaatttgatttcactttttgtaacttaacccacagaaaaggacattaacttagcagataggaccaaggactgaatgacttctgacaaaaagcgtttggtctatccttcacttgttgagctacaaccatgcattacacttctcagctgagctctcaaagagctctatgccctgtgaaaagcagtggctgagttggatgaacacatagcattattaattttgcactgggaaaacagattatgacaggaccacagaccacaatataaaaacttggcagttctttggtgtgatatattttaattagtatttgcaaataatcagagttacttgtgtacataaacgtgtgtttcacaactatggccagatgcaaccttttggtctgtttcaggaaaagacctattattccactaacaattatgctgccttagaaacataatgggagtgtaattgaagaaagcatgtctcagaaggttttgatatgcagaactggaagctattgtaattcctacatacatttccattagctatgccttatgtaatgtgagtgcagatttttacaacttagagttcccatcagtgtttttttgccacatcaccgggtttcttattttactgttttcttttcaactttgggtgctttatttccattctctaaaactaagtttcttgctcttacgagacttagtgttccttttgaacccaggtgttccacctgacagtgtttgtctttcatagactttccagaatagacatagtcaagatcagacacgtgagcttctctctcattttaatgtgaggaaaatcatctttcagagacaaggcaccgcttagaaatgtatgtccaggtatgaaagaacctttttaaaatggctggttgttccagatccagatttctctgcacactggacttcgtagagtaagtgtggtagacaaagagactacactgcacaaccaccagtgaatatcattgctaagaagactttgggtcgtgtttctcagccactctcacagcttttgtagacttatttgattttgaaacaagcagttagctaaatctattttccttttatgcatatatgttaattggctcaacttaatatggtgttcttacagaatatgagcccatttgaaataaggttttaggcaattttgctgttggctctgatttgtatatagcaaatttaaagttacagagtgtttcctagatagaagattagttcatttggttcattttgtctttgaagcaagccaagctcatgagccagttggttatttgtcataaatgaacacccatcactatatgctatgttgaggggaggcaagtctgatcttcgaataattgataaagtttaatatctttgtagccaaaatacaatttgcaaaccctaactccagatgtgtcgtatgaatcttgacaaccaggtcttgagatttgttttactgattgccaatcaggtatattatttgtgatgttcgtgggagcatgcaaattagaagacagtgttgtgggagttcctcagtattgaattacatgtgtgcactcaggcctgccagtcactgaattctgacttgtaaagggtttaacctgctgttccaatcattgaggaccaatttgctttttgataagattggaaaacatttatggagactttcccagttaaatctatgacagtgtccacttaaatagtgcaatttagtatattctcagataactgcaacacaaaattgaaatgtgccagtatgtcatctttctacctggaagatactgtatatttggaaagtttatgcttctctcaataaatacatgttattaaataagccatatcacagtttaagaaattgtatatactttatcatatgccctttcagaaaccaggtattttgcatatgattgattttagaaagattttgaagctggggtttgtccatgttaattaagatcaaagtatatatatatatatatatatgtgctgtatttgcaactttcacattgtaatttcctatacacttattaaagtattgttttgccatgtggtttattaaataaaaatgtacagtctctta

SEQ ID NO: 2745 - DNA, 2684 bp, Homo sapiens
cgatttgtaaaacctccgtgtccccgcgcgtttttatatatggtgggaaacaccagccgcattttcggcccaggtttctttgggacaccggctatgcacactggtgcaccataaccacaatgcggcccggcgccccaccaagagtgttgtaaaaaacgttcttctcggcgtccgatgcgcgtccgcaacacgttttttgttgatgagttagttgacgttgctcttcttggactgaagatggggtctccctatgttgcccaggctggtcttgagctcctgggctcaagaaatccttccacctcgggctcccaaagtgctgagattacagggtgtgagctaccgcacccagccatgaaaacttctgtaaatcttaactatcgtgttctgcttaaagtgaggtacacataaagtttcctgtgctttgtttttgtaggaaaaagtacatagtttgtatctttaccttacggagtctatgagatttgagaatttgatttcactttttgtaacttaacccacagaaaaggacattaacttagcagataggaccaaggactgaatgacttctgacaaaaagcgtttggtctatccttcacttgttgagctacaaccatgcattacacttctcagctgagctctcaaagagctctatgccctgtgaaaagcagtggctgagttggatgaacacatagcattattaattttgcactgggaaaacagattatgacaggaccacagaccacaatataaaaacttggcagttctttggtgtgatatattttaattagtatttgcaaataatcagagttacttgtgtacataaacgtgtgtttcacaactatggccagatgcaaccttttggtctgtttcaggaaaagacctattattccactaacaattatgctgccttagaaacataatgggagtgtaattgaagaaagcatgtctcagaaggttttgatatgcagaactggaagctattgtaattcctacatacatttccattagctatgccttatgtaatgtgagtgcagatttttacaacttagagttcccatcagtgtttttttgccacatcaccgggtttcttattttactgttttcttttcaactttgggtgctttatttccattctctaaaactaagtttcttgctcttacgagacttagtgttccttttgaacccaggtgttccacctgacagtgtttgtctttcatagactttccagaatagacatagtcaagatcagacacgtgagcttctctctcattttaatgtgaggaaaatcatctttcagagacaaggcaccgcttagaaatgtatgtccaggtatgaaagaacctttttaaaatggctggttgttccagatccagatttctctgcacactggacttcgtagagtaagtgtggtagacaaagagactacactgcacaaccaccagtgaatatcattgctaagaagactttgggtcgtgtttctcagccactctcacagcttttgtagacttatttgattttgaaacaagcagttagctaaatctattttccttttatgcatatatgttaattggctcaacttaatatggtgttcttacagaatatgagcccatttgaaataaggttttaggcaattttgctgttggctctgatttgtatatagcaaatttaaagttacagagtgtttcctagatagaagattagttcatttggttcattttgtctttgaagcaagccaagctcatgagccagttggttatttgtcataaatgaacacccatcactatatgctatgttgaggggaggcaagtctgatcttcgaataattgataaagtttaatatctttgtagccaaaatacaatttgcaaaccctaactccagatgtgtcgtatgaatcttgacaaccaggtcttgagatttgttttactgattgccaatcaggtatattatttgtgatgttcgtgggagcatgcaaattagaagacagtgttgtgggagttcctcagtattgaattacatgtgtgcactcaggcctgccagtcactgaattctgacttgtaaagggtttaacctgctgttccaatcattgaggaccaatttgctttttgataagattggaaaacatttatggagactttcccagttaaatctatgacagtgtccacttaaatagtgcaatttagtatattctcagataactgcaacacaaaattgaaatgtgccagtatgtcatctttctacctggaagatactgtatatttggaaagtttatgcttctctcaataaatacatgttattaaataagccatatcacagtttaagaaattgtatatactttatcatatgccctttcagaaaccaggtattttgcatatgattgattttagaaagattttgaagctggggtttgtccatgttaattaagatcaaagtatatatatatatatatatatgtgctgtatttgcaactttcacattgtaatttcctatacacttattaaagtattgttttgccatgtggtttattaaataaaaatgtacagtctcttaaatatctgctctttttattaagtaatattagtaggcctaaaaacattgttcttaaaagaaaatcttttataattataatgtcattttataatgccctcttatatgtttaagaaataaaactgaaaaaaatcttaaaaaa

SEQ ID NO: 2746 - DNA, 487 bp, Homo sapiens
gaggtcaggagttcgagatcagcctggccaacatggtaaaaccccgtctctacgaaaaatacaaaaattagccgggtgtggtggtgggcagctgtaatcccagctactcgggaggctgaggcacaagaatcacttgaacccaggaggtggaggttgcagtgagctgagactgtgccactgcactccagcctgggcgccagagccagactccctgcatcttgcgtggagattgcagtggtgccatctcagcttactacaacctccccctctgtgtgatatgcagtgagaggtttctcacccaagacccacctgctgtctcacatgtaggggacatgctctggactcctgtcctggggaagaaggggcaggagagagagctgtggggaaagtggctgaggtcttttttctgcccagggtgactgggccacattcagggcttggatggtgctgagttcaagggaaagtgcgtccccgacagttgcccttc

SEQ ID NO: 2747 - DNA, 447 bp, Homo sapiens
tgattattgtataactccccatttctaaaatataaatatacggagagatagatatatgtgagatagattttattacttagtttgcagtaggaaaccaaggtccttagcagctatgtatttgcccttggtcacatcaccaagaaataacagagctagatagaagttgattccaaatcagactagtattgtattttctgtttctgaaaatagtgtttaatgtacatcagtcctgaagatatggcagttgtgtttttctttgtacaatcacattcctttttttttcaggtaatatgatgcaagcacacatagaaaagtaccaaggcagcttaagttatcacttataagcagaatgtgaaatgtcacatctcaagaaatatcaggctgtctcagaggaacactttgaagacagtagccactcaactttctcacttacctttgcatactctg

SEQ ID NO: 2748 - DNA, 297 bp, Homo sapiens
ccctaactataagtggataggaaattgttattcacctggataattggaaaaagaggaaacatatgctagaagtctccaccatagtgaaagattcattcagaaaatactcttacaaaatatagtgctacatcatctgttgcaagtgttcactttttttacgtcccattttaaacatggcagctaatagttattttttaagccattttccttttgctcttaagcatccaacacaactatgtttcccagcttcctttttggttaggtatgtcaaagtgactgattctgaccaacagaata

SEQ ID NO: 2749 - DNA, 418 bp, Homo sapiens
ttaaaattggaaacagatgacacacttacattatgttttatttgattacaaaaatgtggcagggatcaaggaaagaacaagttataatgcagaagccccatgctgccagccccgttgctgttatcgccataaaaaaatgatgtgaggatttattctggacagagagacaagcagatccttaagaagagcagtgacctttagtaaagtgagcatagctggcttgaggaaattactacagcaggggaaaataaaataaatacccaatcctcatgatttactcccccttcctatgtccagctttggatccctgtaagccagttctttttttttgagatggagtctcactctgtcgcccaggctggagtgcagtggcgcaatctcggctcactgaaacctccgcctcccgggttcacaccat

SEQ ID NO: 2750 - DNA, 777 bp, Homo sapiens
tctctattcattttttttgaaaagtaccaatggaggatcagaaaggttaaattagaaaaacatctagttgaatccccctgtttttaaatagatggggaaaacccaagaccccagagaatataatcccaaagctaccctgtcacataggcccacaatttcttttcccaatattctgttcttcgctgttccttctaatttgcagaactccctctttaaaaaacctttggagaatgtattggcctcataccctcttccttcagcctgaaagacatgcacctgtcacttatttatgatatttaaatgcaacctctagaacaggggtgtccaatcttctggcttccctgggccacattggaagaagaaatgtcctgggccacacataaaatacactaatgatagccgatgaacttaaaaaaaattgcaaaaaaaaaatctcgtaatgttttcagaaagtttacaaatttgtgatgggctgcatccaaagccctgggccacgtgcagcccgcaggccctgggttggaaaagcttgctctagaaggtactcattgtttgagtgtccagttttctccctgttttccttatttattgatcattttgcatttggaattggtggtttgggcttgtaagtaagaactgtgtactagaacttttgtggtattgcaaatgttttatatctgtgctatccaatgtggtggttataggcaccagctgcctgtggctaattattaagcaactgaaatgcagctagtggtgagcagtaacgttgtggagaagaaa

SEQ ID NO: 2751 - DNA, 299 bp, Homo sapiens
ttatggaaacaaaaactagtaatcccatcactcaagaaataactactgtcaacattttaaacatttttgtgctttgtctttccttcatgtatacatacacaattttcttttagtatgtttggaattgaactagtaattacttttctgtttacttttttacattcaactacatcataagcagtgtctcatgatactaaatatttgaatattactttaatgactacataatattgaaaatatataggtgattagaagtattttctctgccagacgcggggactcacacctataatcccagc

SEQ ID NO: 2752 - DNA, 590 bp, Homo sapiens
agtgaccttatttaattctcgtagtttttctgaatcttggttattttttctgataaatacatactttaccgtgttgttgtacatactaggtaatatatacaagtgcttggtaaacaataaagtcatatacaagtggtagcaataatttaaagcaatattcaaaactcgaagtttagcacacattgtctggaggtaattactcagatgttttgtgggagacatagaaatggacatgtatgtttttaagaaccatgtatttgctgagatggttaaaaaaaaaaaaagaagaaaagaaaagtacatccaaggccaggcatgatggctcatgcctgtaatcccatcattttggaaagtcatggcaggtggatcgcttgagctcaggagtttcagaccatcctgggcaacatggtggaatcctgtttctacaaaaaatacaaaaatgagctatgcatggtgacaaatgcctgtagttccagctacttgggaggctgaggtgggaagatggcttgagccctggaggtggaggttgccgtgagccaagacagcatcagtgcactccaccatggtcgacggagctagaccatatctca

SEQ ID NO: 2753 - DNA, 273 bp, Homo sapiens
cacttgtgcacacaatctgggagacttggagatagagccaccccacctgccacgactgatgcccatgcacaccttgtgggcacctgaggatagggctctctttgcctactgccacctgcacacaatctccagggttctggagattggtctactatacccaccactactgtcactcacaaatgtcatccagtggcataaggacagaccattcctgctcaccactggcaaatgtgcacatatcccagaatcccaaggactggcctgctcagccca

SEQ ID NO: 2754 - DNA, 151 bp, Homo sapiens
atgaaaaacataaaattgccatcttaaacattttcaagtacagtctagtggagctaagtacatttacattattttgcaatggatctttagattaattttatcttacgaaagtaaaatgtaataataaataaactgcccttttcctctcttc

SEQ ID NO: 2755 - DNA, 821 bp, Homo sapiens
caaaactctgtctcaaaaaatatatatatatccctaaaactacctcagttgaagaattcaaagtgcaaaataacttttcttaggattttttaatctattccccccaaaatggtggcttaagtgttctcaaatacataaatatacacatatacgtatatgtatacgttttatatatatatacacacacacgtatgtgtgtatatatatgtatgtacgtatatatatgtattatatatacacacatatgcatatatatatatatatatatatatatatatatatatatataatctcaaagaagtgcggtctgccatttatctgccattttgaggatttaggtactacataaaatattagaaattcatttagaccagatctgtaaactggtagttcacataggccagtttgacccacagttattttattagatgtacataatgtttcaaaaatgtttgaatttgaaaagtcttttgattgggtgtgtgttccccagtttgccacagcctactggacttccctcttatatcagacaacttctctactttgtagttcctgctcagccctgaagacctctaagtttgagacccctgatttagatctgtaattagaaaaaggttctgaatttcatgatttgctaatgtaattactattaagtcattttagcatgtgcattttagagtccttctttgtatttttgtaatgtggtgctttctctcataaagataattgaattgttaacactgtaattgaaattttaaaaatcatttccaaatcttttattatatttcacagtaaaagtctatttaaaaagctaatcattt

SEQ ID NO: 2756 - DNA, 354 bp, Homo sapiens
ttggggggccacttctttcttttcctttccgtttctatctctgtctgtctccgtctctgtctctctctttctcacttgttgccaatgtcttgttgctgagaaggaacactctattcagatgccatccaggaaagaaaggccagatggatggagggtccactgtgtatatttgtacagaatcatttataaagttttctacacttctaaaaaaagtatttctaacttgggctgttggacagtttgtgtgcctctgagccagcaagcctgttgtttcttgtgtttagtgcaatgtttagtgagaaaccaatgtctgaattatttatgccaataaaaaatttgagaattactgcattg

SEQ ID NO: 2757 - DNA, 399 bp, Homo sapiens
tccgtttgcaaatcactgatctggacctgaggtgaccggtctgcagcccacggcccacatgtgtctcctccccaccgccccagcttcacaatggggccatgatataattacaggatgaagaatcagagctgcaccatgttgcctcatggctaacgtatccagaatgtacattttaatggccaaagagcagtgctgttattctcatggacgttattctagtcaataagataggtgatttaagttgtaggggaatccgttttcactagaactgtgtaagatttattgaatgaaatatgactcataaatattttcttttctttttttcttacctttggtctggacttagtcctaactcttttgatggtaaagatcagaagaaacctattcaaacaagctctg

SEQ ID NO: 2758 - DNA, 392 bp, Homo sapiens
aagatctgagacaggtgtgattgagcttcttagaataaacacgtggtaacataaaggttgttacagtaaaaacaaagatgaatgtactataaaatcttcatagtaagatgcaccctgttgtttagtatgtaacaagaaaccattgttgtaatatcctgatgtaaggttatgtttctgaattatattcaaaccaggtggcccctcagttttgaatacttaagaactacagctgtggatttaatgggtttaattaataggaaattcacttcaggttcatccatttgacctctgctacatagccaacagaaattacatagaatgtttctaaaacttccagaaaattcaggctagctttagcattcttcacctagcataggtgaagtcttaattct

SEQ ID NO: 2759 - DNA, 427 bp, Homo sapiens
ctccaaaagaaaagaaatgtcaataaatatttttcaactctttaagccagggtttctgaacgtccaccccactgacatctgggaccaggtaagtctttgttgtcggggcacctgtgtgcattgtaaaatgttcagcagctcctggactctacccactaaatatcagtagcaccctccccacccccagttgtgacagccaaaactgtctccagatattgtcaaatgtaccctgagaggcaaaattactactacattgaaaattactgatttaaatggaaatatctggtgagctagttgttgccttcttacaaaccatttaaaacattcacctctcctcatctcctgagaagaagagtttagtgctttccctgttctaatcttgttttcttagtacagcaaaacacagctatgtagctatttcatgggc

SEQ ID NO: 2760 - DNA, 714 bp, Homo sapiens
taaccaccacctcctatcctttgaccccttgctattcatagaggtggagggtcctcaaaatggcagcattaatatcccctgggagtgtaagaaagctgaagctgcagtttcacaagatcctggggagatttgcatgcacatctgagcatccagtgtcgtcgctgcagcagcccttcatccgttgccgtcactccttttcactgtcagcgctactttgccttcatgtccctttttacccatctcagatgtcctgtcccattttagtgacacttttcaaacaccctttaaaaattaccatcggccgtgtgcggtgtctcacgcctgtaaccccaacactttgggaggccaaggctagtggatcacaaggtcaggagattgagaccatcctggccaatatggtgaaaccccgtctctactaaagatacaggatttagctgggcgtggtggtgggcgcctgtagtcccagctactcatgagtctgaggcgggagagtcgcttgaacctgggaggcggaggtcgcagagagctgagattgcgccactgcactccagactggcgacagagcgagactgtctcaaaaaaaaaaaaaaaaaaattaccatcaactcacttgtttcccttccagttttaacttaactggcaaattttgattatggttgaatttaggtatcttctttgtgcctgtgcctgaacagaaatgtgttagaagagaaa

SEQ ID NO: 2761 - DNA, 444 bp, Homo sapiens
taaccaccacctcctatcctttgaccccttgctattcatagaggtggagggtcctcaaaatggcagcattaatatcccctgggagtgtaagaaagctgaagctgcagtttcacaagatcctggggagatttgcatgcacatctgagcatccagtgtcgtcgctgcagcagcccttcatccgttgccgtcactccttttcactgtcagcgctactttgccttcatgtccctttttacccatctcagatgaggtgtctccagttcatgacacaggtcaatcaccgtcaccactacgatcttcctaggaacgacatatgacgcaatctctcctgaactctacacaacatattttgtctaccaagacccgagttgtaacctacctgttattatgaattcgaacagcagaccccgcgattccgatacgctggtatggattgggggatat

SEQ ID NO: 2762 - DNA, 853 bp, Homo sapiens
gaagatcatactgcattataaatttctgtaactaatagtaatcaacaattgtctattttgttctacccatgcaaacagactctagcactgtccaatcctgtacccactagctacagcacaatttgacaactgaccacttgaaatgtggctactctgaatctaatttcagttaatttaagtgtaaacagccacatgcagctagtggctactgaattgcacagtgcaggtctagactcctaaagcagtgcttctttaccttggtttcataatgggatcacctgtgaagctttacaatacaccgctgcctaggccccttgccagagcaattggattttaatctgtgggcccagaacaaggacgtttaaagagctccccaggtgattttaatacagagagaaacactgctctagtgttccctttatactctccctctcccccatcaattagtaccctcatttcaagaaaaaaagggcagtgtttttgatctgttgatattttatagatacttctaataactttccttatatctatgactggatctataactccaagtattatctgtgtctcttctctcaaattttttgtcactgataaaatagggaatggctaatatatacagtattatctatggaatcataaatatgtattaaaagtagacagaaagaatatcaacttcaggttaatcaagagagggaagaggaacataggtattgaaaaatccaactgtagttaatgttctattgatgtaaaaattcttttttaagtttttactgcttttaattgtagaaataaagagctaaaccatagcataactctttttgcagtgacaattctgttcatatacaggggatgt

SEQ ID NO: 2763 - DNA, 3021 bp, Homo sapiens
  misc_feature (3021)..(3021): n is a, c, g, or t
cctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaaaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcggn

SEQ ID NO: 2764 - DNA, 3045 bp, Homo sapiens
  misc_feature (3045)..(3045): n is a, c, g, or t
cctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaaagcaccttggatttgaattaaaggaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcggn

SEQ ID NO: 2765 - DNA, 3027 bp, Homo sapiens
  misc_feature (3027)..(3027): n is a, c, g, or t
cctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaagtgtcctgtgggatacaccggggacaggtgtcagcagttcgcaatggtcaacttctccaagcaccttggatttgaattaaaggaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcggn

SEQ ID NO: 2766 - DNA, 3003 bp, Homo sapiens
  misc_feature (3003)..(3003): n is a, c, g, or t
cctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaagtgtcctgtgggatacaccggggacaggtgtcagcagttcgcaatggtcaacttctccaaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcggn

SEQ ID NO: 2767 - DNA, 1080 bp, Homo sapiens
  misc_feature (20)..(20): n is a, c, g, or t
  misc_feature (1080)..(1080): n is a, c, g, or t
cctcccccgcgccggccggncctggccttggcccatgcctctgcctctccccgcaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcggn

SEQ ID NO: 2768 - DNA, 803 bp, Homo sapiens
gcggccgcggcaagaagcacccagaggggaggaagcgggagagggagcccgatcccggggagaaagccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaggcacctgggctgcactgcttagaacttggtacccagagccaccacttccccatctcagcctcccctggttccagccaaggttcctggaaccaacttccccaacaccctttgtcagccctcgggggagagggcagccctggtggagatgcggtcagaacaccaggtcctcagagctgtgctggagaagggcaggggggtggggggcagggcagagcccagaggccattctgcgggtggacgagctgggagggaaggtgggcaggcctcttggggttcctgatgacacctgaatggaataaaaaggaaagaacttaggaaacggaa

SEQ ID NO: 2769 - DNA, 3080 bp, Homo sapiens
  misc_feature (3080)..(3080): n is a, c, g, or t
cctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaagtgtcctgtgggatacaccggggacaggtgtcagcagttcgcaatggtcaacttctccaaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcggn

SEQ ID NO: 2770 - DNA, 3104 bp, Homo sapiens
  misc_feature (3104)..(3104): n is a, c, g, or t
cctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaagtgtcctgtgggatacaccggggacaggtgtcagcagttcgcaatggtcaacttctccaagcaccttggatttgaattaaaggaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcggn

SEQ ID NO: 2771 - DNA, 2162 bp, Homo sapiens
  misc_feature (2162)..(2162): n is a, c, g, or t
gcggccgcggcaagaagcacccagaggggaggaagcgggagagggagcccgatcccggggagaaagccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaaatgtccaaatggattcttcggacagagatgtttggagaaactgcctttgcgattgtacatgccagatcctaagcaaaaagccgaggagctgtaccagaagagggtcctgaccatcacgggcatctgcgtggctctgctggtcgtgggcatcgtctgtgtggtggcctactgcaagaccaaaaaacagcggaagcagatgcacaaccacctccggcagaacatgtgcccggcccatcagaaccggagcttggccaatgggcccagccacccccggctggacccagaggagatccagatggcagattatatttccaagaacgtgccagccacagaccatgtcatcaggagagaaactgagaccaccttctctgggagccactcctgttctccttctcaccactgctccacagccacacccacctccagccacagacacgagagccacacgtggagcctggaacgttctgagagcctgacttctgactcccagtcggggatcatgctatcatcagtgggtaccagcaaatgcaacagcccagcatgtgtggaggcccgggcaaggcgggcagcagcctacaacctggaggagcggcgcagggccaccgcgccaccctatcacgattccgtggactcccttcgcgactccccacacagcgagaggtacgtgtcggccctgaccacgcccgcgcgcctctcgcccgtggacttccactactcgctggccacgcaggtgccaactttcgagatcacgtcccccaactcggcgcacgccgtgtcgctgccgccggcggcgcccatcagttaccgcctggccgagcagcagccgttactgcggcacccggcgccccccggcccgggacccggacccgggcccgggcccgggcccggcgcagacatgcagcgcagctatgacagctactattaccccgcggcggggcccggaccgcggcgcgggacctgcgcgctcggcggcagcctgggcagcctgcctgccagccccttccgcatccccgaggacgacgagtacgagaccacgcaggagtgcgcgcccccgccgccgccgcggccgcgcgcgcgcggtgcgtcccgcaggacgtcggcggggccccggcgctggcgccgctcgcgcctcaacgggctggcggcgcagcgcgcacgggcggcgagggactcgctgtcgctgagcagcggctcgggcggcggctcagcctcggcgtcggacgacgacgcggacgacgcggacggggcgctggcggccgagagcacacctttcctgggcctgcgtggggcgcacgacgcgctgcgctcggactcgccgccactgtgcccggcggccgacagcaggacttactactcactggacagccacagcacgcgggccagcagcagacacagccgcgggccgcccccgcgggccaagcaggactcggcgccactctagggccccgccgcgcgcccctccgccccgcccgccccactatctttaaggagaccagagaccgcctactggagagaaaggaggaaaaaagaaataaaaatatttttattttctataaaaggaaaaaagtataacaaaatgttttattttcattttagcaaaaattgtcttataatactagctaacggcaaaggcgtttttatagggaaactatttatatgtaacatcctgatttacagcttcggn

SEQ ID NO: 2772 - DNA, 1767 bp, Homo sapiens
cctccaggtcctggcgcacagggtgggagcgctgcgctgcgccgcgctgcgcatcgcggcccgcttgccgcctgccccctgccctagctgggccacctccccgggctgccggtggagggctaagaggcgctaacgttacgctgtttccggttttccagcgggctctgtttcccctcccaaggcggcggcggctgagcggcggagccccccaaatggcctggccagatgcggcaggtttgctgctcagcgctgccgccgccgccactggagaagggtcggtgcagcagctacagcgacagcagcagcagcagcagcgagaggagcagcagcagcagcagcagcagcagcgagagcggcagcagcagcaggagcagcagcaacaacagcagcatctctcgtcccgctgcgcccccagagccgcggccgcagcaacagccgcagccccgcagccccgcagcccggagagccgccgcccgttcgcgagccgcagccgccggcggcatgaggcgcgacccggcccccggcttctccatgctgctcttcggtgtgtcgctcgcctgctactcgcccagcctcaagtcagtgcaggaccaggcgtacaaggcacccgtggtggtggagggcaaggtacaggggctggtcccagccggcggctccagctccaacagcacccgagagccgcccgcctcgggtcgggtggcgttggtaaaggtgctggacaagtggccgctccggagcggggggctgcagcgcgagcaggtgatcagcgtgggctcctgtgtgccgctcgaaaggaaccagcgctacatctttttcctggagcccacggaacagcccttagtctttaagacggcctttgcccccctcgataccaacggcaaaaatctcaagaaagaggtgggcaagatcctgtgcactgactgcgccacccggcccaagttgaagaagatgaagagccagacgggacaggtgggtgagaagcaatcgctgaagtgtgaggcagcagccggtaatccccagccttcctaccgttggttcaaggatggcaaggagctcaaccgcagccgagacattcgcatcaaatatggcaacggcagaaagaactcacgactacagttcaacaaggtgaaggtggaggacgctggggagtatgtctgcgaggccgagaacatcctggggaaggacaccgtccggggccggctttacgtcaacagcgtgagcaccaccctgtcatcctggtcggggcacgcccggaagtgcaacgagacagccaagtcctattgcgtcaatggaggcgtctgctactacatcgagggcatcaaccagctctcctgcaagaccccattgtacaaagatgccatccctgggtgctgcctgtgtcccttcagcccctagcccccactccatgggatgaggggataccagcaaggacactactctagggcacctgggctgcactgcttagaacttggtacccagagccaccacttccccatctcagcctcccctggttccagccaaggttcctggaaccaacttccccaacaccctttgtcagccctcgggggagagggcagccctggtggagatgcggtcagaacaccaggtcctcagagctgtgctggagaagggcaggggggtggggggcagggcagagcccagaggccattctgcgggtggacgagctgggagggaaggtgggcaggcctcttggggttcctgatgacacctgaatggaataaaaaggaaagaacttaggaaacggaa

SEQ ID NO: 2773 - DNA, 415 bp, Homo sapiens
attttggtttgttagttctttttgttttgttttgttttgctttgttttcatttttggcctaatccttgggtttaaagttcagggctgcaggtaaggggcagagtggcaaggccaatacaaatggtaacggtggcaaggaacccagctggcattggcaggagcccgtgccggggtgttgcaatgcctgtgtcttgctatcctggctctctctttctggttttctttcttttggtaggtgtcctgtgggatacaccggggacaggtgtcagcagttcgcaatggtcaacttctccagtatgtctctttcttctatttcttctcttccctggtgactgacagtctccccctggggagggatggggccttgcttagcaagactagggggagatgtagagggtgtcctgcgctccttaga

SEQ ID NO: 2774 - DNA, 392 bp, Homo sapiens
gcacagggatgcctaatgacctgcaatgcatgggacagtcctctatagggagaaattctccagcccaggtggttgaacagaactcccactgggaacacttcacagcccagtgaggaagccctgaagatagctgtggtcttacgatatacagacagacagacagacagacaagatattcatccatggttcctggctcataactcctaacatctctaagatctccaaagtacgatgttttgtgtgtcttttgtctgataaattcaaagtggggctggtaaccagaaaggccaaggcaggatcagagggttggaactttcagccccattccccaacctctggggaggggagaggagctgaaaagttgatcaccagtggccaatggcttaatcaat

SEQ ID NO: 2775 - DNA, 1118 bp, Homo sapiens
  misc_feature (314)..(314): n is a, c, g, or t
  misc_feature (323)..(323): n is a, c, g, or t
ctctctctacaaaaaatcaaaaaattagccaggtgtggtgtagtcccagctactcaggaggctgagatgggaggatcacctgagcctaggacgtggaggctgcagtgagccagaatcatgccactccatgccagcctggtgacagggtgagaccctgcccctccagaaaaaaagaatttgaaatttataggtacttctggcttttagaaaccagagactgagtaaataatttattttttaaattaatatacagtaaaattgacattttgatattcatacagttctgtgaatatcaatttgtataaccaccaccnaccaccacncacagccaggacacggaacagttccatcactccagataactccctcccactgtcccattgcactcataccctcccctcaccctgggcaactatcgatctgttgtcactgtagtttcgtcttttgcagaatgtgacatggactcatatagtatgtaacctttagagactggcttcttttagtcatagtaatgctgctgagatttttctaagtatttgggtttatcaacagtttgttcctttttattgccaggtaatactcctttgtatggatataccacagatcacgtacattcgtaaccatttgagggacatttggcttccagtttcgggtgattatgaacagagccactgtaaatgttcatggcaggttttggggtgaatataagtttcatttcttgtgggtaaatacctaggagggggattgctaggtcatatagtatgtatctttaacttataagaaattaccaaattgtttctacatccctactggaaagacataaaaattctacttgttccacatttttgtcagcagctgatactgttaatatttttatgtaggaatacttcattttgagccttatgagaagaatctgggtactaggctcagctctgccatcagctagctgctgacttagaggagccatttaacttttctgaacctcttgtttcctcatctctcatataataggtttattttggatatattataagttctttcagctcccaaattcattgatttggaaaggttagtccttggcaagaagacgagagatttgtttgcttgtgaaaaaaaaa

SEQ ID NO: 2776 - DNA, 445 bp, Homo sapiens
tggcatagctcctaccagtcaaaggttttgattctgtgcttcccatagaactttctgtgatgatggaaatgtcccatatgtgtgctgtccagtgtggtagacactagccacatgtgactaatgagcacctgagatgtggctagagtgactgaggagctgaaattttcattttattccattctaactaatttaaatagtcacacatggttagcagctgtcatactgggcagcgcagctatgggtaaatcttaatatcagtctatgatgacagcatattcccatacttgcctgagcctgctgggaatctgaggccatgtgggcttggtgatcaggcagacctgagttcgaatcctggctctgctactaatcagctgtgcggctttgggccagtcactcagcttctctgggcctgaatttcctcatttgtaaaataagacttagagta

SEQ ID NO: 2777 - DNA, 442 bp, Homo sapiens
ctactcaggaggcgtgacggcaggagaatggcatgaacccgggaggcagagcttgcagtgagccaagatcgtgccactgcactccagcctgggcgacagagcaagactccatctcaaaaaaaaaaaaaaaaaaagaattgataacagctgtgctgccaaggctattggaacgtaggaggtcctaggacagtgctgttgggagcataaataagcccaaccctgtggcgggaaattgggcatcagttctcaaaatgtcatgggctgggcacggtggctcacgcctgtaatcccagcactttgggaggctgagggaggcggatcacttggggtcaggagttcgagaccagcctgaccaccatggagaaaccccgtctctattaaaaatacaaaaaaaactagccaggcatagtggcacatacctgtaatcccagctactcgggag

SEQ ID NO: 2778 - DNA, 1742 bp, Homo sapiens
gttgatgtcagtgttgcggtcagtactcctgcaggactcatcacacctatgtgtttaatgcacatataaaaggagtggaaaccatgctaatgatgtgtttctttagcaaccaaagcaagagagggtaaactacagccacatgaattccaggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaacagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcagaaaaattaattctcttgggggaagggcttgaattgaagctttactttagaatttagccctggtttgaaattttcccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaattgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaaatggtaatttctactttgataaagtaaaaaagttaaatgtgtgtaaaaaagtgttctgtgtccttctactccagcatcgtctcatgtaaaataagaaagccctaaaatactattggagagaaaaaattaactaggttgctactttatttgcctaaatacttttttctattttgttagattttgcctttcttttggaaggaaggaggcgatattctggattataaaaatgaattgggaacattatcacaattccagactttctattaatatttatgtgttttaataaacgtttgaa

SEQ ID NO: 2779 - DNA, 297 bp, Homo sapiens
aaattaaaaggttttgttccacgaaagatccttaaagaaaggatgaaaagacaagccacatactgggagaaaatatctggaaatgatatatctgactaaggactagtacactataatagattacataaagaattctcaaaactcagtagtaaaaagaaccacccaattcgaatatgggcaaaagaccatgaagagacatttcaccaaaaaagatacacagatggcaaataagcacatgaaaagatgtccaaaatcatttgccatcagggaaatgtggctacacatcgatgacaatga

SEQ ID NO: 2780 - DNA, 431 bp, Homo sapiens
cctcctgggaatacagcaaagtcataggaagcagataacttatccaagaaaattggtagagttgttctccctcttcaagtgtaaattccaaactatctgctcgtattttagccttaattctttagttttcatgcagaaactaccattttcaacacagaggacagattcagaaaagcttgattctcgagccttattcaaggcttaaaataagctaatttaaaaaaaaatctgtcgctgtattataatcagtgaattaatagacaataaaatagttttctaaccattttgaatttcaaaactaaggcttttaacttattttttatttttcactcccttaaaacagcaggaagtaaataattttaaattcactgctttttttcaaacatgcattttaaagtaatttagttatttttaaagctgtgacttaagct

SEQ ID NO: 2781 - DNA, 452 bp, Homo sapiens
gtggcaagcgcctgtaatcccagcttcttgggaggttaaggcaggagaattgcttgaaccctggagccggaagttgcagtgagctgagatcatgccactgcactccagactgggtgacagagactccaaaaataaaaaaagaaaaagagaaaaagaaatagaaagcaagcaagcagcttcagagtgggaggctgtagacgtcgccaacctttccttgaaatcaggtttatgcactcatttattaactcattcattcatacattgcctctttattaagtacctctttggtacaaacacttcggtaggcttgggtgcaaaggtgaatgtcttccagataggaattctaaaagagttggaaactcaggagattagggttaattttcgtaatcacagatacttgacttttcacccggcctcccattcctttgtcaatgccagaagccagtgtctgc

SEQ ID NO: 2782 - DNA, 466 bp, Homo sapiens
ggggagctggggtgtgccggaccctgcacccaggtcaggatgctcaacatgccaggcctcaggaaccccttcacaccccattagtcagtcctcactaccgtcaagggcagccactctcctggcgtcatcggaccttcaacagacctgcgctgcctgttcttgaaatttatagaaatagattgggccaggtgcggtggctcacgcctgtaatgccagcgctttgggaggccaaggcagatggattgcttgaggtcaggagttcgagaccagcctggccaacatggcaaaaccccgtctctagtaaaaatacaaaaaaaattagccagtgtggttctgtacacctgtagtcccacctactcaggaggctgaggcaggagattgcttgaacctggaaggcagaggttgcagtgagccgagattgtgccactgcactccagcctgggcaacagcgcaggactccatctca

SEQ ID NO: 2783 - DNA, 665 bp, Homo sapiens
ggcgggcgcctgtagtcccagctactctggaggctcaggcaggagaatggagtgaactcggaaggcggagcttgcagtgagccaaagtttgcgccactgcactccagcctgggggacagagtgagactctgtctcaaaaaataaaataaaataaaaaataaaaataaaaacttgaattattagcatgaatattgcagttctttatattatgcaaaaccagatttaaataagagcatttaattcatatatggaattgccaagttataccattagtactttacagcacatcttgggaggttcccttgaactagccagaagaagcaaactgaagccagacagaggaagattgcaaagaggaagagagggtctccaccaggcacagagccacccaagggagccctccctcaggctcagggataccgagggagccagagcagattcacacaggtccctggggcccctctgccctggtgactctaggatgcatgtacttgcacctgacttctaggcatccccctcctgctagcttcccctcgatccagcctggggcaggctctgtggaagtcaagccttgcatctccctttcccaagcacctaccatcctaacccacagtgtagtggccacgtccaagggtctttacgtctctgcctcagatatgctaggt

SEQ ID NO: 2784 - DNA, 349 bp, Homo sapiens
agcatttttaatgagaattggtaaagtggctacaaagtttcaaaagctttagagaaaaatacatatatatattccaattggtgttctaagactaatatataaacatattggtgcagttgccaagtagcaaattagtacatctttataatggcagagaagagcctgattgaagaatattaagccttagatagggaatttacagaaataataagttaagacaatctattaagttgacattattctgttcttttttgtaacatgctgtttaaactctttgacttggttgctgctacatggaagaaaatctcatataagaacagattccaaggtgtgatactcatcatatatg

SEQ ID NO: 2785 - DNA, 158 bp, Homo sapiens
cattaattgtattacagagattagagagttgaaacccagaaatatcaaatgtgtgtcgagtgccccacactaatgccatattgatattcatacccagtctagccacagcctggctttctcacagttgtatttctagttgtatttttcattcctttcct

SEQ ID NO: 2786 - DNA, 441 bp, Homo sapiens
gatcatctgtacttgccatatcccacttatgaacaatgtctttttctaccctgtgtttgtgaaatgtgattttactcttaacattaagaaagaaacagatagtgaatataaatacaaatttgaaattttgataaaatagttattcagaatttaatgtaaggccgggcacagtggttcatgcctgtaatcttagcactttgggaagccgaggcaggcggatcacttgaagtcaggaattcaagactagcctggccaacatggtaaaaccccgtctctactaaaaatacaaaaattagctggatgtggtggcacacgcctatagtcccagctactcaggaggctgaggcaggagaatcacttaaacctgggaggcggaggttgcagtgagctgagatcacgccactgcactccagcttgggtgacaagagtgaaactctgtct

SEQ ID NO: 2787 - DNA, 405 bp, Homo sapiens
gaagggagaagagtggaagtggaggtgggaatgaagcttcccaggaggtgaactgctgttcttggagttgttttccctgtcaggaaaaacatcaagggatgaatttagagcagtcccgtagaaatataatgctcaccgtttgtggtggcttacgcctgtaatcccaaatgctttggaaaccaaggtgggaggattacttgaggccagcagtttgagaccagcctgggcaacataagcaagaccccatctctacaaaataagaataaaaaattagccgagtgtggtggtacacagctgtaatccccactactcaagaggctgaggaaggaagatcgtttgagcccaggaggtcaaggctgcaatgaactgtgatccagacagtgcaagactctgtctcaaaaaaaa

SEQ ID NO: 2788 - DNA, 416 bp, Homo sapiens
aaggggaggtatcaaggatgaatctcaggattctggcttaagcagttgagtgagtggtgttagttctcactgagatagcaaataggaagacaggtttgggggaaggtaatagtttgcctatagatttgttgaatttggggtgcctggggaaaatttgagagggaagatctctgaagcagtttggatatgttgggtaaggcttaggaaggagaaaagggctgtaaatacatatttgatagtcatttgtacacatgatttgagttgaagctgtaggagtgggtaagacagatcagggagggaatagattgcctaccatgagaaaagagacctaggagagacttttgaggaacatctttatttttttacagtggtagaagaagagcatcccacaaagaagaagaaagaaatggagaagg

SEQ ID NO: 2789 - DNA, 449 bp, Homo sapiens
aatatacacttgaaattaaactcaaaaaactgtaatcctgtaacgataaaataaaaattatagtaaaaagggaaagttaatctttgttttaaaaataacaagtaccaaagtcatgtaaagaagctaaaagtactggtcttgaattatggcttcatcaagtgttggctttttgaaattagagaagttattggaatgtctttgtgcctcagtttctttatctttaaaatggggataattgcaatatctaccttgtaggattgttaattcatataggacacttggaacagtacctgaggtgtggtaaacactagtaagtgtttatttttattatgctgaataaaggctgtagatcaagaatgtgtcccaaagttgtgaatagagtgtcacaatgtatccaagaattgtgaagcaatgattctgtacaatacaataaagtttaattatttaca

SEQ ID NO: 2790 - DNA, 423 bp, Homo sapiens
cctcctggacttgggtgatcctcccaccttagcctcccaagtagttgggactacaagtgcgcaccagcacgcccggctaatttttgtattttttggagagatgggatttctcttatgttgcccaggctagtctcgaacgcctgggctcaagcgatccacctgccttggcctcccaaagtgttgggatgacaggtgtgagccaccgtgcccggcccccttcactcttctataccacttatttccatttatgtctacttaaaaagtggtactagacctaaagaaggggaaattgattgggaaggcttgctttctttcttttttttgagacagagtctcactgttgtcgcctgggctggagtaaaatggcgcgatctcagctcactgcaacctccgcctcccgggttccagcaattctcccgcctc

SEQ ID NO: 2791 - DNA, 1583 bp, Homo sapiens
ggaagtgtgcgcagagcacctcagcctgcctgggtgtgcgcatctgcggcatgcaggtttatcaaacagataagaagtactttctctgcaaagacaagtactatggaagaaaactctcagtggaggggttcagacaagccctctatcagttcctacataatggaagccacctccggagggagctcctggagcccatcctgcaccagctccgggccctcctctctgtcattaggagccagagttcataccgcttctattccagctctctccttgtcatctatgatgggcaggaaccaccagaaagagccccaggcagcccgcatcctcacgaggctccccaggcagcccacggtagctctcccggtggtctcaccaaggttgacatccgcatgattgactttgctcataccacatacaagggctactggaatgagcacaccacctacgatggaccagaccctggctatatttttggcctggaaaacctcatcaggatcctgcaggatatccaagagggagaatgaaacttcctgggcttatctggattcttctgggctatagatctcaaatagagacctgttggttgctagggtagtccagacaccccttagatgtcttcataatagtcctatctaccttcaaaaaccatctctatatatggcagactatattaacagctgctgaacaaatcagctctggaggtgattccacatcccctggcattatgctctaatgctgctcatcggagaacagacagccaggataaagtggcaccttctggagtacactggagggggcagcccaagttagaggccagcattgctgacattctggaatatttgcatctaaaaatgtttactcgttgccatgctgcagtccgcacaagctgtgaggcagaaaacttgacttgaagcagccttgaagagtgagttcatgagctcatggtttttctccttgtatgggactgctcgctccaagggcaggcagagctcatgaatgcctcttatcttcctaagcggagttttaggtgacacaggatgaagcagaaggagatctacccatctcatctgctctgcacccagcttctaagtggacaaagccaagcccaggcatgagctctggcaaagcaagaccccagattctcccatttttgcctgtggaaaggagggtccctttacaggcttttttttcctttttttcccccaaaatctcttaaaatgaggaatctcttagcagactttggagttccccattctgccacattctgaccatgagacgcggcttgcagtgggggtgaacgcacataaaaagggaccactgacgtcctgctctactctctgctttctatttatttattttgggggtgggttggggagtcagaagaacctggaggacggaggaaaccaggggcaatgtttacaagactggtggacaagtgtaaatatggaataagaacaaacagttctaattaattccttcttctgcagtatggaaacctattacgatgcccttgagtcaagcactgagatacgttacccaattagggaaataaatttgttaataaaattgctgaggtcaccagt

SEQ ID NO: 2792 - DNA, 485 bp, Homo sapiens
  misc_feature (71)..(71): n is a, c, g, or t
gagaccagcctggccaacatggtgaaaccccctctctgctaaaaatacaaaaattagctagacgtggtggntgtgtgcctgtaatctcagctgctcggaaggctgaggcaggagaatcacttgagcccgggaggcagaggttgcagtgagccgagattgtgccactgcactccagcctgggcgacagagtgagactccatcaaaaaaacaaaaaatccctggcgtagagcagtattgctgatgaattgaggtgttttatagacaaatttttttaaaaatttatatattataatgtgaaatagaaaagcaaactcagatgccaaacctatgattttatgaatattctcgcttaggacttacgtaaaggttttgtgaagcactaaaattaaggagatctgtttttcacaaatttgagctctcttaaaatgtcgggatggcacggtggctcacacctgtaatccagcactttgaggggacgaggcagg

SEQ ID NO: 2793 - DNA, 904 bp, Homo sapiens
atgagcccttctctctaatgcatttttcattcctgttcctcttttgcttcactttccctctatcgactcttgcgacctgtgtctctgatgtctctggggcccccagttctgtcttgccataccaaaaaaccttcttcagcaaaaaacctctttctgggacagttcatatcactctatgaataggcccctgaagtgttgaggtcaaggacatgtgtgaacgtggaaatgtatttatggaaagaccctacactgagggtctctaactaaacatttcaggtatgatgggcaaaatgctggtttgttacagaaatgactgaagaagacctaggggccatagtgggccacaggccaagcctgcaatacagcctgaagtgtgggaaagaatgtatcagtcctgttgatggagtggtgtgtttgctgtctctataaatatgtcagggtttgaaagacagaaaacaaagcatctttgctgaccgccagactcccagggtatatgtggctactgcaaattagcgaggcttgtttatctgcttcaacttgactcaatttgcatttcttgagccactgtctattgtggataatgatttcatcaacactttctcagcatcagcagcccctccagagtattccttgaattttcttagctttgtgcaacccacgagcacttaatatatcactaacccttgagtttattggagggagtgaatgaaataatgaatgtcaataacgttacgcaatacctggcacacagtagtggcaacaagggggttctttcaacaccaatgactcccaaatccctctgggggatctcgaaacgggcgaacacggggggggcccctatagtcccaacaggggggacgagaagaacccccaaggagctcaagtgtagaccccaccttcctcc

SEQ ID NO: 2794 - DNA, 288 bp, Homo sapiens
gtgcttaaaattccatagtaaatgtattcacttttctctagcaatgtcagagctaaaaaggggaattattgtcagcagcataaacagattatgcttatgaaccaagccacaagaaaggagttcatacttctttctggtagatgaatgctttgtcaccccatgtcaccctatggcaaaagtataacattcaaaatcaactgtagaaaagagacaaatacagattcttcagaggggtgaataaaaactattttcatatacatatgtcagttcttataaaaactagccagg

SEQ ID NO: 2795 - DNA, 803 bp, Homo sapiens
tcgatttggaattaagttacattacagagaaagtgtgggtccgtgtttttctctctgtttgggaaaaggtgggttggacagaggaaggatggcccagggttataagcttggctccagtacagccgggagacccccaggcagcatgagtcggtgggactggacctgcctggctggtgtccagaggggcccgtagccagtgggacggtgctgcacgtggtcgtgcctcaagccctccactgcaccgggcgccctggccaaccctgccaggaagtaaggagaccggggaggccactgagggcctggacctggctgggtagtcagaagtgggggcaagtcttggctggcagcccctgagatgtgtagaatgtttgaaaattcgcctgtgggttgacctgaacccaccgggcttgaaaccaacggtccaaagtttggagtgtggtcttaaggaaggagaccactactactcctgctgccttcctcccaccaccttgcctagttcacaagacaggaggagagaaaatgcaaaaagttggaaaaaaaatgcaaaagtaagataaacagacaaccttggcaccaccacccggccctaggagttaaaaaaaaagtaataataacatcaaccactgacctaaactacttgtgttatctgtaaattccagacactacgaaaaagcattgtaaaactttctgttgtgttagctgatgcatgcagcccccactcacgttttccacacttgcttgatgtatcacgaccctttcacgtggaccccttaaagttgtaagcctttaaaaaggccaagaat

SEQ ID NO: 2796 - DNA, 237 bp, Homo sapiens
gagaagttaccaaaagcagcaggaaaagtttaaatcattcactccccaaattttgctttcagcttagcttaaaggaaaccccaggatggagatggctctgcccaagcccgagagcaggcagacaggaaagccagcccagaagaggaggcaggtacaggtgcccacacctctggcctcacctcatgcatgaaggcacatcccgatcttggcaggatttctcatctgccctccaatttg

SEQ ID NO: 2797 - DNA, 560 bp, Homo sapiens
agcccccaagttgtaaagaaatatatatcatgctccggctcctccaaatgtaaaaaaaaatcagccattcctatctaattttgaccacgtgttcatattttcaacttgttttaattgtagcaagtaagaaaacttgacattctctagtttttcaaaggaaaggtgacgtatacatgcttcctaataggagatcataaccacttttaaaaacacatcagccaaatatacggaagagattgctttatggtaacacaaggaagaaggatctttaaaaataattcctggccgggcacggtggctcacacctgtaatcccagcactttaggaagccaaggtgggcagatcacgaggtcaggagatcgagatcatcctggctaacacggtgaaaccctgtctttactaaaaatacaaaaaaaattagctgcgcatgatggtgggcgcctgtagtgccagctactcgggaggctgaggcaggagaatggcatgaacccgggaggcagagcttgcagtgagccaagatcatgccactgcactccagcctgggtgacagagtgagactc

SEQ ID NO: 2798 - DNA, 328 bp, Homo sapiens
aagttatatgtgaaatgaatatttgtcacccatccactgatttgcacctgtaagcaaatccagatatccagcccacagtctatactaagtgcaataacagaggaaccaaaagacatctgttcagagaaggaaatgcctccaagcctgcctgttctttttacttttgtctcgaagcagttatgctcatgcagttgcagtactggggtgagtgcctggcaattccatgccgctctgtataccctgggagatgaacactctggagcagttttctgaagagcttacataaattagaagttaaatattcaaataacaggggttccgttttgcc

SEQ ID NO: 2799 - DNA, 573 bp, Homo sapiens
gcggccgcctactactactaaattcgcggccgcgtcgactaataatatatcttggcaattattcaatattaatatgtaaatagttgcctctttctttttcatgcgccatataatatggacttataatttatttaacctctatctaggttggttttaggcattggttattacaaataatgctgcattgaatacctttgtatgtaaagtcatttcccacatctatgcctatagaataaattactagaattgaaataattcagttaaagattatgtgcatttttaattttggtagttattgccaaactgctctcaatggaagttttatgaattcccactagtgaatgcatttgtcctcacaattatgtcagtgaaatttttgttctttgccaatgcaagaaatggaaagtatctcttggaaactaatttgcatgttttttttccttgcacagttatattttcatatgttaaagagccatttgtatttcttggtgaattgttcataaactttgcttacttattatctaatgtctgactaatttgctacactctaaattcccaattcatacttaagtc

SEQ ID NO: 2800 - DNA, 1616 bp, Homo sapiens
gtattaaagggaccggagcggggcagttcccgacgccgcagcgctcgctttcccttccctcctctctggccctccctcctcccacccactggctccctcccccagcgctctccagtttctgtgccccaggagctacgcgacagtcttccaggattatggagtttctgagcgagaagtttgccctcaagagccctccgagtaaaaacagtgacttttacatgggcgcaggaggtcctctggagcacgttatggagacgctggacaatgagtccttttacagcaaagcgtctgcaggcaaatgcgtgcaggccttcggacccctgccccgcgccgagcatcacgtgcgcttggagaggacctcgccctgtcaggacagcagcgtgaactatgggatcactaaagtagaaggacagccccttcacaccgaactgaatagagctatggacaactgtaacagtctccgaatgtctcccgtgaaagggatgcaagagaagggagagctggatgaacttggggataaatgtgatagcaatgtatccagcagtaagaaacggaggcaccgaaccaccttcaccagtttgcagctagaggagctggagaaagtctttcagaaaactcattacccggatgtgtatgtcagagaacagcttgctctgaggacagagctcactgaggccagggtccaggtttggtttcaaaatcgaagggccaaatggagaaaaagggaacgttatggccaaatacaacaagcgaaaagccattttgctgccacctatgatatatcagttttgccaaggactgacagctacccacagattcagaacaatttgtgggcaggaaatgcaagtggtggttctgtggttacttcatgcatgttaccacgtgacacttcctcctgtatgacaccttattctcactcgcctcggacagattccagttacacggggttttcaaaccaccagaaccagttcagccacgtgcccctcaacaattttttcactgactctcttcttactggggcaaccaatggacatgcatttgaaacaaagccagagtttgaaaggaggtcttccagtatcgcagttcttcgaatgaaagccaaggagcacaccgccaatatttcatgggccatgtaacatacagtactcttttatttttcttttaatagcaaagttaaacattcttatttctcatatttaaaggataccacaataagctgctgtgtgtggaattgctaaaggtcaagatattcagtgagaccagcttaaatgaatagttgttatttaacattaaaatctaagaatgaacctctgaaaagactaaataggtttaccatgtgccagtctccacaaaccctgttttagtagtaaggttttctttttctattgtacaagtcaatgaaatatgatcacgcaacttattaaagaataaatgtgttaaacaaattcttctgttatagattgatttatgttacttctgtataacaagaaatctcatgtaaaataatacctgataaagaaggaaatgcactggggaaaatgtcaagatgccaaagtcgtcaggtaaatattgaatcagggtgttctggggagttaactgctctctctctctctcca

SEQ ID NO: 2801 - DNA, 1442 bp, Homo sapiens
gtattaaagggaccggagcggggcagttcccgacgccgcagcgctcgctttcccttccctcctctctggccctccctcctcccacccactggctccctcccccagcgctctccagtttctgtgccccaggagctacgcgacagtcttccaggattatggagtttctgagcgagaagtttgccctcaagagccctccgagtaaaaacagtgacttttacatgggcgcaggaggtcctctggagcacgttatggagacgctggacaatgagtccttttacagcaaagcgtctgcaggcaaatgcgtgcaggccttcggacccctgccccgcgccgagcatcacgtgcgcttggagaggacctcgccctgtcaggacagcagcgtgaactatgggatcactaaagtagaaggacagccccttcacaccgaactgaatagagctatggacaactgtaacagtctccgaatgtctcccgtgaaagggatgcaagagaagggagagctggatgaacttggggataaatgtgatagcaatgtatccagcagtaagaaacggaggcaccgaaccaccttcaccagtttgcagctagaggagctggagaaagtctttcagaaaactcattacccggatgtgtatgtcagagaacagcttgctctgaggacagagctcactgaggccagggtccaggtttggtttcaaaatcgaagggccaaatggagaaaaagggaacgttatggccaaatacaacaagcgaaaagccattttgctgccacctatgatatatcagttttgccaaggactgacagctacccacagattcagaacaatttgtgggcaggaaatgcaagtggtggttctgtggttacttcatgcatgttaccacgtgacacttcctcctgtatgacaccttattctcactcgcctcggacagattccagttacacggggttttcaaaccaccagaaccagttcagccacgtgcccctcaacaattttttcactgactctcttcttactggggcaaccaatggacatgcatttgaaacaaagccagagtttgaaaggaggtcttccagtatcgcagttcttcgaatgaaagccaaggagcacaccgccaatatttcatgggccatgtaacatacagtactcttttatttttcttttaatagcaaagttaaacattcttatttctcatatttaaaggataccacaataagctgctgtgtgtggaattgctaaaggtcaagatattcagtgagaccagcttaaatgaatagttgttatttaacattaaaatctaagaatgaacctctgaaaagactaaataggtttaccatgtgccagtctccacaaaccctgttttagtagtaaggttttctttttctattgtacaagtcaatgaaatatgatcacgcaacttattaaagaataaatgtgttaaac

SEQ ID NO: 2802 - DNA, 180 bp, Homo sapiens
taaaaagttctatttttcccctttgaattttctcagtacccttgtcaaaaatcaattgaccataatatgagagtttatttctggattctcgattctattccattcatctctatgcctgtttttatgccagtaccatactgtcttgattactgtggctttgtagtaaatactaaaattgag

SEQ ID NO: 2803 - DNA, 369 bp, Homo sapiens
gagcaaggaagctggagtgagggagggaggcagaaaggagagaggacacggtgggtcacagcacccaggggtacctgggacaggcactggcctttggcttttcaacatggaggattcaggcaggccctgtcctctctgcttttgaatctcttgcctgagaggggaatcctaattccaccctcccctgcccaacccaaccatgatgccagtgggtcgctggtgcctcctctcacagaggcaaggtctagggtggggttggggattccaagtggagatggggtttgtggacttcgacttgggaagagtggaccactgaatgcacttctcaaaatgacagggccctgtttgttggtggggactgcaagttgg

SEQ ID NO: 2804 - DNA, 500 bp, Homo sapiens
gctatttctgtacctcatttccgatttttgtcagtttcctttttttttatctataaatttgttccgaccacgaggcatccctggtgtctctctaaatctgctgtgattctgggggctgcccgattcgcaaattgtttgttgctcaatcaaactcctttaaatttaattcaactgaagtttcttttaacaagtacaagatcatcattattttttgccaacccttataattgatccctctatctttagtccttttatttattttcttactcaattactgaaataaagaggagaaatgaactctagaggcagaaataatctcagcatcataaataaaaccatttcccttttatagcactaaatgcccacaagagaaagcaggaaagatctaaaatcggcaacctaacatcacaattaaaagaactagagaagcaagagcaaacaaattcaaaagctagcagaaggcaagaaataactaagatcagagcagaactgaagacaca

SEQ ID NO: 2805 - DNA, 446 bp, Homo sapiens
tgacagagtttcactctgtcgcctaggctggagtgcagtggtaggatcttggctcactgcaacctccgcctcctgggttcaagcaattctcccgcctcagcctcctgagtagccgggactacaggcggccacaccatgcccggctaatttttgtattttcagtagaggcggggttttgccatattggccaggctggtctcgaactcctgaccttgtgatccgcctgcctcagcctcccaaaatgctgagattacaggcgtgagccaccacgcctggcccaagatttcttaatatgcacgttttcatgtacttcttttaaaataactgttaaacaacaatttgaaacacacacacacacacacacacacacacacacacacacacgaatatagcattgactcgtctcacagaggaaaagtaaatgtaaaaactaagacataagattt

SEQ ID NO: 2806 - DNA, 691 bp, Homo sapiens
ggacagtacatgaatcactcctactaagagatcctgaaagaggtcatcaaagccaccagaaactattcctggacagaggaggttttataggtgtggttggtctccttactgacgtgtcaactacaaatgcacagggttctgcctgaaatgttttagttgttgcagatgtgtagcttctatatgtaaagtcttcactgcatgtgctacagaaacttgaactatctgaagagaggatggagtcatcagatactgggaacaagaagactaagcaataagtgagaaaagaaatgatggaatagatgtgaggcttccacagcaaactcctgtaaaacctgcagttaaacctgagcaagaggaatgtgacatatgtgtctttgctctttatttggatctgtgtgtatgctcttggagcagtggcgaagaagctccaggtaaggtatagagttctttatttttcatcaagctaagatttttaatgaaacaatatccaaaatgcttgctatgaaagattcaagtgatttttgtagttctacattcttgggtaggagaagataaaaaatgcagttattacaactatattatgagcctcttctaaccttttctttaaagaggtaggtatttatatttctaataaataaaaacgttgtatcaaataagtaaaataaacaatgttattttacatatggtctac

SEQ ID NO: 2807 - DNA, 442 bp, Homo sapiens
ggacagtacatgaatcactcctactaagagatcctgaaagaggtcatcaaagccaccagaaactattcctggacagaggaggttttataggtgtggttggtctccttactgacgtgtcaactacaaatgcacagggttctgcctgaaatgttttagttgttgcagatgtgtagcttctatatgtaaagtcttcactgcatgtgctacagaaacttgaactatctgaagagaggatggagtcatcagatactggatccagtcaaaatatttggatgctttcagaaacatctgcctagctgagatgtggggaaggaacataaagcattttctctcccagtccctgctgaaagggtgagcctgtggtctatatatataggaatgactaaagttaattgttaagaattatttgataggcaaaaataaaagctaatgctttatatag

SEQ ID NO: 2808 - DNA, 283 bp, Homo sapiens
ggtatgaatatagcaagttggttttattatatttatgtttagagattatagattgtccttttatgtgacatgttttccccacaactgttttttccacatgtgcaggaggaggttttataggtgtggttggtctccttactgacgtgtcaactacaaatgcacagggttctgcctgaaatgttttagttgttgcagatgtgtagcttctatatgtaaagtcttcactgcatgtgctacagaaacttgaactatctgaagagaggatggagtcatcagatactgg

SEQ ID NO: 2809 - DNA, 398 bp, Homo sapiens
ggtgtttagaatgttgagacacggtcagaaatgattggtggtttcatgtgatgcaaagaatttcccatactccgcctgttttctggatcacctgtccccagaaattgcctgaaaacaaatcacaggttgaaactagaaataacttccctctcctaggcagcttggagactggccaccctgtttcttggtttggtaagaatgttccagacacaaggaggggagcaacacacactggggcctgtcgggggttggggtatggggagggagagcattaggaaaaataactaatgcatgctgggcttaatacctaggtgatgggttgataggtgcagcaaaccaccatggcacacatttacctaagtaacgaaactgcacatcctgcacatgttaccccagaa

SEQ ID NO: 2810 - DNA, 245 bp, Homo sapiens
ggaggaggaacagtttcaagttggtgagagtgttgaggggagggaaaaaatggctggtttgtaagatccttgaggtcagggattatttttatcttgttctcttttgtaatcccagtgcctagtacaatgcctgactcaatcaatgtgaatgagtgaataatgaatcaatggtcaaactaatgaactgggggtctgaatgaaaatgatgaggcactttcactcagccaataaacttttaccagccc

SEQ ID NO: 2811 - DNA, 292 bp, Homo sapiens
ggggattttatagtttttaccttcacatacaaaagttactaaatgatcaaataaatgaagaaatgagtaaaagaaagaagcaaagtgtggtgtgaactagtggatgtcagttataactacagtggaaagagaaagctggcctccccagtctgtatccccaacccttggccattttgctgcttcagccacatgttatgagagaggctgcaggtatgtctttccagcacattcactccatttattacggtaaggctgttggcgcgatttggagtccctgactagcagggcttgc

SEQ ID NO: 2812 - DNA, 293 bp, Homo sapiens
catctgcaggggaagaacgaagttgggaagaaacagtgaataaaggtggacggtgcttcactttttatagcttctcttcccaccctaggggaatgagtggtacggatggtaaatacacccaactcctccctcaagcttcctgcacatttgagggaaacaatccttattaaaatatgggaggggccaggtgcggtggctcacgtttgtaattccagcactttgggaggctgaggcaggtggatcacctgaggtcaggacttcaagaccagcctaggcaacatcgcaaaaccctg

SEQ ID NO: 2813 - DNA, 381 bp, Homo sapiens
cttcaccaccagcccaagtctaaagaaactcacaaatctgctagtgagtcaccacctccctctcctctgagcaactgtaagatacctagtagtagccctgccctatcctggaattagccagaacgtcctcatgtagcctaccaagaccgcttctggccctgtaatcaccagtgtgcatttgaattctgactccactatatatcagatgtatgggtttgggtcagttacccaatctcattaagttactgttttcttatctgtaaaaccctgtatctcatgtagataatgtattccctgcttagcacagtccctgcacagaatgtgtagtcagctatgatggtgctggtggtggcagcagcagtggcagctttcaaaggctga

SEQ ID NO: 2814 - DNA, 441 bp, Homo sapiens
aaatgacagggcaaggcttgagccagatcttctgagtcctatccagtgttctttccaatctactgcttgttttgtaaagcatggcacttgcttataaatccctctgaagaaataaaactctctagctctcatccttgtgtatttaccctagaaatatgaacatttatgtccacacaaaaaccttacacgaatggtcataacagctttgtttctattagcaaaaaactggaaacaactgaaatgctcttcaccgtgggcacatataaacaaattgtagaatattcacatagtagaatactacttagtaataaaaaataaaaaactattgatgtacacaacaaattcagtggctctcagggccattatgatgagtgacatagcaaatcacagtattttacatactatatgattccatttacataacattctagaaatgagaaa

SEQ ID NO: 2815 - DNA, 588 bp, Homo sapiens
aagccccggggtcaggtaagtagcctcaggggctcccttggccagagcttctgttcaggcgctctccatgaaagcagccctggaaaactgagcctgaagtcagagacagctcaggcccagcacagggggcagtcccttgccactggctcgggcccttccctggactttttgccttcctccatttttgcttctctgggtctgtcttcgtccatgcctgctctgagatgctcccccacccctccctgtacctgggaccaccgccctctggtgttttctttctcctgtgagtccccccctggatactgctgctttctggaaggctgtcctgggttacgtcctgcgctcctctccctcccacgcaaagacaaccagaaggacaagccttgagcacgccgataccccagctcgtggctccccagaccatctgtttcccgtgaagacgccccgctccccgtgtctgtgtcctgcgtgtatgtgtcgtgtgttgtgtagattgtgagccccctgggcagggatccctgtctgcatacatgttccatgtggcacgcccaggtgtgctaataaacgttcatcttgcagaaaaaaaaa

SEQ ID NO: 2816 - DNA, 423 bp, Homo sapiens
ataatttcaacgttattttttaaaattaagatgaaatgaacaggttacaaccagtaaataaagagcgacttaacactcttgttacctcattaaaattatttgctgtttttaagttcatttcttgctatttagattctggagagaatcttgaccctcgaaatggaagatctgattttgggtcctgctgtactactcacagggtgctcatacatcctctcgaattactcacagtctctggggcttattttccccctataatattggaattaggatactggcattgagtaatttagagggttttagtgaggagcaatggaaataatattttaaaaaatgctttgttacacacaaagtcctgtgcaattgtaaggtattacgtttaatatcggaactcaataaaatttctatattaatcaaaataat

SEQ ID NO: 2817 - DNA, 485 bp, Homo sapiens
taattaccagcactcctgctgcaggcagccacccatggggtccaagtggcctgtggaaagccagccctgatcaaagagccctctgcagccgctcctcacacagagccagttccatgggacaccccagtagagagcctgtaagtttgtgtgcacagtcctgcatcagcaatggcaggttctctcttaccctgagcttattacacctgggtatattgccatgtggagccacatgtattcttttagaaccactcccttatcccaagcccttttttcacaatgaaggcttgcgcctctgcaatccaagtagacttcctggaagtagtgtctttgctgaagatgttgtggacataacagacacaccaggctctgctagatgacgtccctgctgccgctctttccagacagagctcaggtgccagcggccaccattctgactcagcggtggtcataatggtccttttgtgggggacaggcctttgttaggg

SEQ ID NO: 2818 - DNA, 730 bp, Homo sapiens
agttcatcctgacttccagttatttacgaggaagaaagttttggagtagttggcctctgacagtcttgcgtacagcttacatcatccataaccaaagcagtttagtccttcctgttgtaggactaataacttgcaaactgcttctgggagaacccatcacagaaattcatgaaacttgttgaattgacagtaaacacctggacaggactcagtaaatatggcttaaaagtgacagactgaatgaattcctttgttcaacaaatactgtttagctacctgtttggagccaggctccctctaagtgctaggaatacagaggtaaacagagcagaaggtcctggtcttacagagcttactttctagtagggagaagacagtagtaagaaaatgtaagaatttctgagattaatgctatgaagaaaaccaagcagggaaatgagactgagggatgggacaaggtgggacaagcacacccgtggttgaggcagtcagaggaggcttcctgagcgctgagacaggaacaaaaagaagccagccacttggtgacccgggagaagagtgttccagacggaaggtgccgcatgagccagaggggcaggggcagggtggaacttgtgggtgccgcatcaagagaagccccatgtgaatatgtggagcctaagtcacatgggacgttggccagagaaggagcctgccgtttcttctatctgccgtggaaaggcatgggggg

SEQ ID NO: 2819 - DNA, 957 bp, Homo sapiens
gacctgccccatccttgactctcagcttgccatgtgacatgctttggtgtaaagaataaggtggaagggatgatgtcctggttttaagcccagaggtaggcctgggctcctgtgtttctgtatcattatgagagcatggctgggttcacctgcttttccaggaggaggaaccagtgggaacactaagatagccataaacttcttctctattacactatacccttttctaatctgtattttgactttgttaacaaatcctcaagtcaataaatattcttccataatatattttttggagattcttgccactacacttctgggaaacaaatgaacaaattacattttctatgtattatttttctgcttatttacattaaattaaaaaaattcacaaaacaaggaatacgctattgcagagtgggttaggcagtggaattccttttctaaaatacaatgttatctatttaaagcacactcagcaaaatggcttggctaccttcaccagaattctctaccataacattaatctattactttagcgtttcagaaccaagaattcatcctcaagtactattgtccttcataaaccattcccacaatttttttcattatttgaaaaattaaacttattttgagatgattatagatttgcatgtagttgtaggaaatactacagagattctgtgtaccctttatctaatttctcccaatagtagcagtttgcaaaactatagtacaacctggcaaccaggatattgacatcacagcattccattgatcttattcagatctctccagttttacttgtactcatttgcaaaacaactttagaggctatggaatattctattgtattgataaatgtatcagattttcttaagcaatcccttaatgttgaacattagtatgtttctaattttcagtgcaataaaggtttcataaacaaaaaaaaaaaat

SEQ ID NO: 2820 - DNA, 210 bp, Homo sapiens
ttttgagattttattgagtactactaatcttgacatattttggttggcaccacattcttggtatagtgggttagtggttgaatagtttgcagactttgtgaaacaaaatcctcatttaatggtttagtttggctacattttgaaaatatacaaaaacataatgcacttttattttatagggaattttttttcaacttgtggctttgtttt

SEQ ID NO: 2821 - DNA, 341 bp, Homo sapiens
tttttttttgagatggagtctcactttgtcactcaggctggagtgcagtggcgctatctcggctcactgtagcctcgcctcctgggttcaagcgattctcttgcctcggcctcttggtagagatggggtctcaccatgttggccaggcgggtcttgaactcctgacctcaggtgatctgcctgcctcagcctcccaaagtgttgggattataggcatgagccattgtgcctggccccataaacaccatttctaatggctacaaaagcatatattacattccaaaatctaagccattattgttaaatataccaaacactacagaaacaaacattttaataag

SEQ ID NO: 2822 - DNA, 470 bp, Homo sapiens
agtaagaggtgtatcaggcagtccttgaaggagggggcatatgagtgctttcaggctggtcttgaactcctggcctcaagtgatctgcccgcctcagccttccaaagtggtgagctaccacacccagcctgattttcatcatctacgtatttagctcctacagaagatttttaaaaatagaatacgtggctgggtgcggtgactcatgcctgtaatcccaggactttgggaggcctaggtgggtggatctcaaggtcaggagtttgagaccagcctgaccaacatggtgaaaccccatctctactaaaaatacaaaaactagccaggtgtggtggtgcacatctgtaatcccagctactcaggaggctgaggcaggagaatcacttgaacctgggaggcggaggttgcagtgagcgaagattacaccactgcactccagcctgggcgacagagtgagactctgtctcaag

SEQ ID NO: 2823 - DNA, 324 bp, Homo sapiens
tgtaacatcctcacccctgttcctttattacttatgcttctcagatttcttccatgcagaataaactagcttaatatattccaagtcacacttcaaaatagctttgttacctccctccatgcttattcctcccgtgttccccagagccgcttccctaagaaatgtaggcagcagagagctaagctaaggggtttgaatcagtgctgactttaggagcctacaacaaactataaacagccagtggagttttggttctcccggggctcctgtgtaagcagaagccctcatcactacatctggaaaaggagaagcatatgtcagcag

SEQ ID NO: 2824 - DNA, 369 bp, Homo sapiens
gtgcccggcagagagcaaggacccctgaccaccggctgggttggtcctgggagggccccggtgatacctggggggtgtacaccatggagcagagcctcctccagtgtagcctgggagcctctgtgaggccacagcccccaggaagagcacagtgctgcattcccaggtgctgccggctgcgcccctcccagctgcgtgtcctcacctgccggccccagctgtcgctgcccacgccctgcctgcctctcctgacaggaacttcccaagcagaggcctcaggtagcaggcgctccttgtcccctctgccacctgggctgctgagggtgtatcaccaggagtgagctcaggacctggacacccaagcccagg

SEQ ID NO: 2825 - DNA, 357 bp, Homo sapiens
attcaggttcccgtgtgagaagggatactgtgattcattcttctgaagagctggtggagagcccccacccccatcccatcagtagcccctggggactgaagcaaatgggcaagtcggtctatccccaagccacaacccctgcgtaatgatgatggagaccttcaagcggccaccccttggcactgcagcctttgaataacaaggaaaagcaacagctgtgagaataaattcttgcatggtaaacttagggcctcgaactcagagtcgaagcactgtatttctcatcatattccttccactagggttgtgatgatcttgccagaaagtgttgtttctcggttttctcctgtcttttct

SEQ ID NO: 2826 - DNA, 453 bp, Homo sapiens
cttgaatagatttagaaaggtcactgaagaggcaggtggattacaggagttaagggggacccttctccactccttatgtttacttccacatgaaggaccatcattaatttaactcacggcctggagtacttacctgatttgtgaatttgggagaaaaaaattgacatctcagcttcatcctgttttcctctttggagggagctgccctcaggaagcacccttatcttgggggagctcttctgcccatgggtagactagcattggcgtcttgctgctgacacaggttcagtgtttttttgtgtgtgtttgttttcgttgttgttgttgttattttcgagactccatctcaaaaaaaaattcttactctgcactatttttaaattctcccgatgtggtccagtaaactagtgagttggcttatgaatatattctgccagagacttagaaaacaaa

SEQ ID NO: 2827 - DNA, 481 bp, Homo sapiens
ctctcaggcctcagtgggcataagagtcacgaagggtcgtgtatttgaaatgcagactccctggccctgccctagagaccctgattctgcaggtgtgagcgaggccctggaatctgcattcttataagcccatcctgtgattccattgtcgggaatgctgcaaagtgctgctctcagccttagagtcgaagttcgtggctgggcacggtggctcacgcctgtaatcccagcactttgggaggctcaggcgggtggatcacctgaggtcaggagtttgagaccagcctggccaacttggtgaaacctcatctctactaaaaatacaaaaaattagctgggcgagttggtgggcacctgtaatcccagctactccgggggctgaggcggggagaaccgcttgaacctgggagctggaggttgcagttagccgagattgtgctattgtacttcagcctgggcaaaaagagcgaaactccatctc

SEQ ID NO: 2828 - DNA, 184 bp, Homo sapiens
tcccagtactcctcagaccacagcacaaaagtccagcaagttactccccaccccaaccccacaggggcatagagacccctgggggatgggagctgcttggcccagatggtcaactatcttaatagagtgtgggaggccaaggaggaagggcagagcctgtgggcaggacatgtggcccaacaga

SEQ ID NO: 2829 - DNA, 284 bp, Homo sapiens
actggtctttatttctcattaccattatgtcaggtagaaacaattaaggggaaacagtgagtgcctggagatgttctgacttaataatagtgagtttctttatcaaggctgtcaatgggtaaatacaaggcacacaccataaaccaaggctggccacgatatggttctgagccacctagctctgccaagtttgtgaacagattttaagattctaagaatgtgccatttcagaagaaaggagagggaatccatggaaaattagcctgctggtgagagagacatta

SEQ ID NO: 2830 - DNA, 398 bp, Homo sapiens
agtaacctcataatgcattcctgaggagcccagttagtccttgctcctgtccatcccacctccttcaggcggtagaacagaagaagggtcttcatctcaccccagctaaagcatctctgcttccagaaagtgtggatgagtgggagccataaacctggggaaataagccacatgctacccttttggttgttgtttattttaacaaaattctatgaccccagggaccatgtttctaagagtagccacttgaagcagaagggaaatatttagttcaaattctacaatcacagccaaatacagtcttaatgggcagccagcaggacactgtgggaaagagagtgttcacacaccattcttatgtgggggagttagggatgatgaagaatcagtcataggtc

SEQ ID NO: 2831 - DNA, 440 bp, Homo sapiens
gctgtgagttctgcagcttcacagaaatgaatttggccgacaatcatgtgagctccattagaaatgcaccctaagctctctcaacctctcccatcccccacagcacctatttactgattatctgtacatgatagcagggcaggaactagactctcagccccctgaggacagaccttgtctgtcagtgcatttcactgtctgtcccagcaccttgcacagagcctggcacatatcaagaacacggcacatttttattgagacagactcctcaaagctggaatctaaaaccaatggcacctaatctcagccaaaaaggttaatgtgacacctgtgcttttattacccatttctgcagatggaagggttggttgtttgtggctatctcaagtgaaatgcagaattagtgaataaaattttcatctgaatttaaagaaaatctt

SEQ ID NO: 2832 - DNA, 1204 bp, Homo sapiens
tttaagcaactgtgtgcggctaagtgatgcctctgttatgaaactatctgagcgctgccctaatttaaactacttgagtttacgaaattgtgaacatttgactgcccaaggaattggatatattgtaaacatcttttccttggtatcaatagatctctctggaacagacatctctaatgagggtttgaatgtgctttccagacataaaaaattgaaggaactttctgtatctgaatgttatagaatcactgatgatggaattcaggcattctgcaaaagctcactgatcttggaacatttggatgtctcttattgctcccagctgtcagatatgattatcaaagcactggccatttactgcattaacctcacatctctcagcattgctggctgtccaaagattactgactcagcaatggagatgttatcggcaaaatgccattacctgcacattttggatatctctggttgtgtcttgcttactgaccaaatccttgaggaccttcagataggctgcaaacaactccggatccttaagatgcaatactgcacaaatatttccaagaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatatcagcagtgaagaccaaagcagcgtgaccttcagcctcaagcaggaagaacaaaaaatcaagaacttggcaagttttctccatttgttgcaagtatgtttactagctgaatctcaataacaatgtaaacaagcaacaaaccatcttctgattcttattccaactacaaatatttccaaacacatcagtagttcttctgtctaaataatcatgatttaaaaaagaagccaggccaggagcggtggctcacacctgtaatcctagcactttggtaggccaaggcgggtggaccataagtcaggagttcaagaccagcctggccaacatggtgaaaccccatctttactaaaaatacaaaaattagccgggtgtggtggtgggcgcctgtaatcccagctactcaggaggctgaggcaggggacttgcttgaacctgagaggcggaggttgcagtgagcctagatcacgtcactgcat

SEQ ID NO: 2833 - DNA, 889 bp, Homo sapiens
atgtgtagtttccttacccattcactgtatctgttaatttctgaactggctgaatcagagttactgaggctttgggaccctgtttatttgtacacttacccatatcctcactctcagcaaggcaagagaggtctcatgtgaattcagattgtgacagtgaattccctaactccaaatttggttgagtttgaaaattttgcactaggggttacttctgcaactagctaatgctaagcactgttattacaggaaggcagctcaaagaatgtcatctaaagttcagcagcaggaatacaacactaatgaccctccacgttggtttggctatgatagggaaggaaaccctgttacagagcttgacaacataacatcatctaaaggagccttagaattaacagtgaaaaagtcaacatatcagcagtgaagaccaaagcagcgtgaccttcagcctcaagcaggaagaacaaaaaatcaagaacttggcaagttttctccatttgttgcaagtatgtttactagctgaatctcaataacaatgtaaacaagcaacaaaccatcttctgattcttattccaactacaaatatttccaaacacatcagtagttcttctgtctaaataatcatgatttaaaaaagaagccaggccaggagcggtggctcacacctgtaatcctagcactttggtaggccaaggcgggtggaccataagtcaggagttcaagaccagcctggccaacatggtgaaaccccatctttactaaaaatacaaaaattagccgggtgtggtggtgggcgcctgtaatcccagctactcaggaggctgaggcaggggacttgcttgaacctgagaggcggaggttgcagtgagcctagatcacgtcactgcat

SEQ ID NO: 2834 - DNA, 5491 bp, Homo sapiens
gaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaatctaggagagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctaaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctgtcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaacaaaaacaaaaaaaaaacacaaaagctgcttgtctaaaattactatggagttagtggtctattctttttccccttttggcagcaactttacacagcatttttaacaccttttttttctagtttttttgttcggttttgttttccatcaggaatttgagttctctctaacccagcttactgtgggacataggaaaactcagtagaaatacctttggtgatcttgttgagtttaagtctgatcttgatcttaaactcagtaagccactatctgcaattttgtacattatatagtattttgaagatatggaaccttatgaaaaaaaaatagcaaattagttctttttcccccagaggggaaagttatgttctgcaaatagtgtgtgtcttattttactgttgaacagcaattgctatttatttttttattgcctagaacttcaacatgttgtataggaatcctgtagtgccactagttaaatgccgaattctcatctggatgttaccatcaaacatcagtacacttgtcatttcacatgtgtttaatgtgacagtttttcagtactgtatgtgttaatttctactttttttaatatttaaaattgcttttaaataaacatattctcagttgatcccaaaaaaaaaaaa

SEQ ID NO: 2835 - DNA, 331 bp, Homo sapiens
cgagctcggtaccccttttggggtctctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaacaaaaa

SEQ ID NO: 2836 - DNA, 4852 bp, Homo sapiens
gaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaatctaggagagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctaaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctgtcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaacaaaaa

SEQ ID NO: 2837 - DNA, 4681 bp, Homo sapiens
gaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaatctaggagagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctaaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctgtcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaacaaaaa

SEQ ID NO: 2838 - DNA, 5523 bp, Homo sapiens
gaaaagagagcacgcaaaacaacatgggatgatccgcacagagataacaggagctgagattgcggaagaaatggagaaggaaaggcgcctctttcagctccaaatgtgtgaatatctcattaaagttaatgaaatcaagaccaaaaagggtgtggatctgctgcagaatcttataaagtattaccatgcacagtgcaatttctttcaagatggcttgaaaacagctgataagttgaaacagtacattgaaaaactggctgctgatttatataatataaaacagacccaggatgaagaaaagaaacagctaactgcactccgagacttaataaaatcctctcttcaactggatcagaaagaatctaggagagattctcagagccggcaaggaggatacagcatgcatcagctccagggcaataaggaatatggcagtgaaaagaaggggtacctgctaaagaaaagtgacgggatccggaaagtatggcagaggaggaagtgttcagtcaagaatgggattctaaccatctcacatgccacatctaacaggcaaccagccaagttgaaccttctcacctgccaagtaaaacctaatgccgaagacaaaaaatcttttgacctgatatcacataatagaacatatcactttcaggcagaagatgagcaggattatgtagcatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcagaacccacctggctttcaaccaacttgggtattttgacctgtatagaatgttctggcatccatagggaaatgggggttcatatttctcgcattcagtctttggaactagacaaattaggaacttctgaactcttgctggccaagaatgtaggaaacaatagttttaatgatattatggaagcaaatttacccagcccctcaccaaaacccaccccttcaagtgatatgactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggagcttggggagacagcccttcaccttgccgtccgaactgcagatcagacatctctccatttggttgacttccttgtacaaaactgtgggaacctggataagcagacggccctgggaaacacagttctacactactgtagtatgtacagtaaacctgagtgtttgaagcttttgctcaggagcaagcccactgtggatatagttaaccaggctggagaaactgccctagacatagcaaagagactaaaagctacccagtgtgaagatctgctttcccaggctaaatctggaaagttcaatccacacgtccacgtagaatatgagtggaatcttcgacaggaggagatagatgagagcgatgatgatctggatgacaaaccaagccctgtcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaacgatgggggtccatcctcttcaagtaagactacaaacaagtttgagggactatcccagcagtcgagcaccagttctgcaaagactgcccttggcccaagagttcttcctaaactacctcagaaagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggggaaaaataaagtgaggcgagtgaagaccatttatgactgccaggcagacaacgatgacgagctcacattcatcgagggagaagtgattatcgtcacaggggaagaggaccaggagtggtggattggccacatcgaaggacagcctgaaaggaagggggtctttccagtgtcctttgttcatatcctgtctgactagcaaaacgcagaaccttaagattgtccacatccttcatgcaagactgctgccttcatgtaaccctgggcacagtgtgtatatagctgctgttacagagtaagaaactcatggaagggccacctcaggagggggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaacaaaaacaaaaaaaaaacacaaaggcgtgcgtgtggtctttaaaattcacgtgggggttgggtgccaatattctcttttcccccctttgtggcggcacttttccacggcatttttaaccccctttttttcccaagtttttggggttcgggcttggggtttcccccactcgagggaatttggaggttctcttcttcttaccccaagtcttaccggggggggacacatgggaaaacctctcagagtagagaaaaatcacctttggggggggaactcgtggtggaagtttaagagttcgggaactctggaactcctaaaccttcgagttaggccacttatccgggcatttggggcctttaatatagttatccgggaaggaatggtggacactttatgaaaaaaaaatttgccaaatttgtgtccttttccccccagggggaatgtgtttgtgtccgggcaattggggggtgtcttatttaggtggtggaccggcagtggttataattttttaatggcaagaactcaccgtttggtatgggagtcggggtgcctatgtaaggcgaatcttgtgggtggtcctcacattgtacttgtcttcctggtgagggacgttagaggggggatcactttattttaatgttataatttctgtgaaaaaaattgggggcgaattaatggg

SEQ ID NO: 2839 - DNA, 1013 bp, Homo sapiens
ccaggctggtacggctccggagattcccgggatatcgcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcggtactgaagccacaccagtgtccggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaacaaaaa

(The sequence listing continues in the following parts.)

What is claimed is:

1. An isolated protein, having the sequence according to the amino acid sequence of SEQ ID NO: 836875.

2. An isolated polynucleotide, consisting of a nucleic acid sequence encoding the amino acid sequence of claim 1.

* * * * *